United States Patent 10,407,724 (METHODS AND COMPOSITIONS FOR SCREENING AND TREATING DEVELOPMENTAL DISORDERS) - sequence listing, part 8

SEQ ID NO: 142 - DNA, 4300040 bp, Homo sapiens (residues 1-2,150,020 of 4,300,040)
acccagtgttttacgaataaggaaatcaacagagatcagagcaaagaaattgatccaaaatttaagcaagggctcaggaatgataatcatgacacagctgatgagtagtgttgaagaagatgcagaatcagaggaatctcatgggagaccagacatccacacaccacttctagaggctttccaagatggcgtgagccgagagcttcctgtcatctctgtacttaggaaatgtgccatccttgcattgcccttagcctcagttttactgttccttgtacatagcgggattgttacttccatcaagcaaagcagtccttaagtttcatagactgttacagcattgtctaattggctcctcaccctgtttcagataggttaggaaagtatctttaaaaccactttatatgtcaaaggacttgtatttagaatatggaaagaactcaataagactaacaacttaataaaatgggcaaaaggcttaaattgacatttagcaaaaaagatatatgaagggccaataattacatgaaggtggtcaacatcataaatcatcaggaaaatgcaaacgaaaacctccttgcagaaccactaatgctactttattctcaataccaaggtgaggatgagagactgaaacactcacacattgctgatgggcgtgtaaaatggtacaaccactttggacaactgacccagcaatgaaattgctgggtatttactcaggagaaatcaaaatacagacacagaggacttgaacatgaatattattagcagctctattcgtagtagctcaaaactggaaacaacgcaaacatctatcaataggtaaatagataagttgtggcttctgcatgcaatagatatactcagcaacaaaaaacaaactattgattcaacaccatggatgagtctcagaaacattatgttgatcaaaagaagccaaacacacaagaattgatctgtaacattccatttatatgcagctctaggagaggtggaactatgatgatgaaagtcagaaagtagttgcctccatttagggaaattgacttacttgtttacttgctttatttagggaaattgacttacttgcttaagtaaatgggtgagccagtgcttgaactcaggccaacagatctcagggctagggccccactggctacatcacactctctcagcatagaaggaaggtgaggaagaacgaggcacagcagctggggagcagaaggaaggcaggtaaggtatcaggagaaaggaaaggcagaagtcactgaggtcacatttctgtcctgggcataaggctcataatggcacctgtgatggaaagaggcccttccatcgtggccacctgcagaagtaattaggagggcttgacagatgtgggagagagaagcatcatcatccaactggtggagcctgccagtagagaaggtattaaagttattctcttgttggtatccaaatgggatttttatcatcatagtcccacctctcctagagctgcatataaatggaatgttacaaatcaattcttgtgtgtttggcctcttttgatcaacataatgtttctgagatccatccatggtattgaatcagtttgttttttgttgctgagtaaacaataaacttgttttattcgtaagatcttttaaaaattcttcatgacataattaatacatatacactgcagaaagaaaatatacataaaagaagaaaaaataaaacctcctatggtcttattatcccgtgataatctctgatctttgtttttgtttttcagtaaataaaaacattttaaacaaaaatgggatcatatactatacgtgctgttttataatatgccttttaaacaacatatcagtgaacatttctctctatcagagggtataatttctattggatacataacatcctatgggtggatatatccaaattttgtttaaccaaacctctgctactacatatttaaattgtttccagtttttagttactacctactaccccctacaagagaacatcttgaacataacacatttgctcactttttttcagtatttcctcaaggaaaactctagaagtggaaattctaggtcaaatggtttggacatccttaaggaatttaatacatattgtcaattattgtttttgaaatggttttagcaatttacattctcaccagcagtgaatgaatgtgttattctgtgtcaccttaacaggtggactataactttcgtccctgtgctaagtactacctcttttcattgaagcacctgtcaggattagaaattaacctttgatgttgtctagctccatctcccaagcaatggctgaattcccttttggattctgctagtttgaaatgaaaaccatttctttaaaaatgttaatttgaaaacatgattgatgtttgagtgtagtagaaaaattggaggagccagaaacagaagtgatcctggggtcagagtacctgggtttcagggctggccgcgtccttgtctgtagttgtgtaatcaccagcaagttgctgacgtaccctgcctgggtctctgtgtccccatgtctaagacaaggggattgaggggggctcaatctctacattgtctttagttatgacattcaataaatcttcggctatttaaagcattcctttcaagggctgggcttgtaaattaagcgtggcaggcctttgaaatgcagcttgtgtgggaaaggaaacaaacccagcagctagtttgctgctggatcagaattcgatgttctttgtgaagtaataaattgtgtcttggctcctggattgttccaggttgcctcgggtttcacggaagtggctttttcaggaatggttcccattgccggaaagtgggtgttaatttgtgccttggctatttttcagggcacattctggcaaaatcctggcatctttttcagaggatcagcagatgtaatgacctgggggttgctccccttgcaagaggacacatgctctatgttaataccccaaatcaagcctatagtcagaggcctaggttttataatagagcacttatcctgggcatgccaagggtttttgaccaagtggaaacactttgggacatgtaccacaggaaacaggacagcggaatgcttagtaatggttagcatttctaaataaagtatctgctctccactgaaatggggtacaggtggtgtcctggaagaggagaggaagctaatggaagtgaagaaagaataaaatagaataacatctgtgtttggtgctccacagcttgcagcctacattaacatactttatttactctacacaatgtccccaggatatcatcattgccattttgtcccaatttaccaccgagcaaatgcaagggttggagtgttggtcgtgagtggcccaatcacctctgcaacaacctcacggcttggcttaaaataccgtaaatccctgcttccttggcagatcttcatagtctcatacctcctttctcttctatgacaattgaaaaattacttttttcttactctttgagtccatagtcataaattcaagtcatttgccaatcttcagtataatgcaattggaaaacattgtctagtctagtatttcccagactttaatttttaaaattattttcaacttttattttagttatttgcacactgtcttcacaatttatgccacatctgtgtgccacctgtaccattatttacattatttgttttcagacaaattacaatttcacttttttcttgctctaagaactctagtaactgaaatcattagtttgatgtaccagttatagttttctaatgtatgctatcacatagctgttaaaatcttgtgttcattttttgtagtacataatatatctcacttctccctttgatatacacactatactctgaggaattaatttaaatgaaataaaatttcaaaattcagtttcttggttgagttagctgcattttaagtgtccagttgacacatgtagcttaacggctgccatattgggcagggcagactagaacattctgtcatcccaggaagttctatcagacagactcttcctaaggtttgtccagggcacttaaagcagcagacatttcactgctttcattagcctaagctagactaacatacaagattatcaaaagaaaggtgaattaatttaagaactgctaccaaaaatgtcagataatagtttctttcattgaccactgtccaagtaagcagcaagacaagtcaaagcatctgatttgataatggatcacttcagtctgctctaaaccagctctctctcagggctgtctcttcttccatccccgccactcccattctccccttctctccttcccagtccatgtctctcttcagtgtgtgtctgtgttttcgctttcatgcttcttcttcctcttgcttcacctgtgtgtcctaacctcactttcattctagccctcagtcctttctctccctttctgcctattttaccttcccaaccttctgaatctccctcattcaaaatttaagtatatttggattttgttttgtaaattcttcttcaagtacaataatttcaggccaaaggacattctcatttgtaatgtgaataagggatacctcctagcagaattccacaagatgtgataagtctcactggcatctcagctctgtgttaatgcacataaaacgactgtttcctgctcaaacctctgcctgtctctcactgatgtaaaaccataacaaactaattgctttactctactcctcatccaaagtctcctttaaagaacaagagaatttttgaccatgcttctcttcaggcccatggaaaaaggtccaaaccttgctctgtggcattggttacacttcttgagcagactaaaagccaggcattgccttgaaggcctgatgccacttctatttaatcagaactccttccagagccataaggttactggaggtcccccagagggaggaaagtgctgtgtagacatatttatgcttcatctgttggccatgaatgtcaaggaggagaactgactagactgccttctctttgttttaattatccagagattccaaaaggaaaggaaaggccaagtggacccaagagccctcagaagtgcaagatgctctggggaacatatgtgcattgctcaattccatgaaatagacccttccttaggagtacaaaattgaaagtttcccttacttcttgcggggaaacctgtttacctccccccacctccccaccccttccaaatgtactcagttaggctgtggaaaatttaattcctcttgctaatttatataagaagttatgataccttggaaatttttatctgtcagctttaaaacgttaaatatgggatccactattctcaggaaaatgatgtgatgatctgctgtctttctcagacaaagggaggcatttttccaagagtggaagtccctacctgcgtgggaatgatagagacatcctctgactgggttttgtactgctccagactctgaaaaagagaaagagatccaagtttaagtgactttaatcttagtaaagttttaaggtttatgttatcctctggataataataactataatgatgttttgagtgcttggaatttgtggagcagtgtgttaggtgctgctgctgtaaacacaatctcattaatcctcatgacaaccctgatgaggtgactctcccccaccaccatattctaattggaggaatttgagtctcagagaggcgaataatttctcaaaggcaacacagtcaataaattgtcagagctcggattcaaacccaggacagagctttgtggtctttagatccattgttctgtgttggtttattcagcaaatgtttattggtggttactgtggccaggcactgttgctcagggattccacaatgaacaataaaggcaacactcctgatcttatggagcatatgccctggagaggaaagacagaagaacaggaagttaaaaaataatataacatttttaaacaattaataatctggcatgataatttcagatgttggcaatgccataagaacaatagatggagtaaagcaatagtgaatatggggctgctttatgttgggagctctcagaaggattttctgggatgacttttgaactcagacctgagtgatatgaaggatccagaatccagtgttgggggcagaggaaacagcaagcgcaaaggccctggggtgattgagtgccatgtctttcaggagcagcaagaaggccagttttgctgtgtagccggtgggggtgagtgacaatataaggtcagagatatagacaggctttggattttgctccaagtgtaatgggacaccacagggttctaagcagaaacggtatatgatctgaattgtttttttctttttctttttttgagacggagtctctcactctgtcacccaagctggagtgcagtggtgtgatctcggctcactgcagcctctgcctcccgagttcaagcaattctcctgcctcagcctcccaagtagctgggattacaggtgcccaccaccacacctagctaatttttgtatttttaatagagacagtgtttcaccgtgttggccaggttggtctcaaactcctgacctcaagtgatccaaccgccttggcctcccaaagtgctgggatgacaggcatgaaccactgtgcctagcctgaattaagtgttgaaagataactctggtttctatgtatggaacagagtgtacagtagcaagacaggaagtgggaaaaatggttagaagaacatgaacatcagaagggctggaggtttttgaaggaggaggatagtgctttggaaacagcaaagggggagagtgggcaagaaatgactgtttatcctacctccaggccctgggtgtgaggagtgatcctcaggggccagccaggtccagggagtaggcaaaaaggaagggagccttcagaaaagaagatgtagctctaggggagtttgctgcagcggcagtggtggcaaatcacaggatagctagtttttattgaacatgtactgtctgtctagcaggattctaagtgcttttcctgcaataacttgtttagtcctcttggtaatcctaaactgtagatactattattagccccatatcacataggaaactgacagggagttaagaaacttgtagcaagtaagcaatatggctgggatggcattactaatttcagaagtcagagtggaaagttggaggggttgtcagagagggttggagcgtgctctcactaagggaggggtcgactggtctagagatgagacccagatggcaaacgtgacctgggaggttttgatggaggtaaagcttgctccatgatgccatttgccctgaatgacactagaggaagtttccccatcagttcagactggaagcatggagcctaggagtgactgctctttcttgaagcttcccgtggggtggggcccagggcctcctcactgggattgctttcttaggcagcttgtggggcaagaagagtttcgtctaaacaaggcagtgtcttgaccccttttatcccactgcctttgagttgggagaatgttcatatttacacatttctgggatgttttactgcagttctcgtttggagataataatagataacattcatcattcattaagcacttacaatgtgtcaggttctatgctgagcacttgacatatagtattccttcaataaacacagtagtcttatgacatggctactattcttgctcccctttttctgatggactaactgagctctagacaggttacgtcatttgcccaaagtgctatatagtgagtggtggacctgagatttaaaccttacaacctgacaccagaggttatagcctcactctgctgcaagtgaagaagatatgtttgctaggtttggggcaatgctgcccaggaagtctttgtaaatcccaaaagaatgagtgattgtagcaacacaaagtttgaagggaaaccttgagagtgagtggctagcatcttccttccgtgaccatactgatgttgaaatgttggtagatcaactaccagcatcagagacgaacctgaaggtaatggactcaggaggggaagacaagggtgagaaaggggaaattgttgtaaatagagaaaaggaaattattggtttacttaacttgtcttccactacgtgatctaaaagtaacagtactcagataatactttctctctcttttaattccagtaaatgaacacctaaaaaactgcttacttccccactctccctgcaaacaagaaaaatggtgggattatggatacttttctattaagatgttttagttttctattattttaaaagaaaaatatgtggggtatttttaaaagaaattgtttaaataaatgaaataagattctttaggcatcatatttaattgaattcatttcatccctttaaaaaatatattttctttgacattcatctattcctatccaaaaacatgggtggatgatcggatctcagttttcttaggctccgtgatcctggcagagttactttttaatcacttgtctatgtttctccaacttgaaaatacctagacttccaaggcaactgaactgctgtggaagagccatgaacttctctgccaaatggccgtgagtaagaagatggcctcttggattgctctcagtccctcatttgtgttctaaaagaattcattaacctgtagatcagtttggggttttttttgactcacctggtggatcagattttgctgtccctaaatgttcctctgagctccttggagaaaaaagttacgagtaatagacatgtgtttatcattttacaaatgcatattgagtgcctactgcgtttcagactccagatgccaaaatgagtaagctgggatccttcttcctaagggctggttgtttgaagaaattattagaaaaattggtggtgaggggcaaatacagccacctgtgtggtgagccagtctgtgtccctttgtgtaaaaaattccttgaaagttagagccctaatgtcttgaatgtactaatataaaatattcatcatcagttcactgttacaatttttcacccttttacacctgatgtgaactttgggctttgcacctcatgaaggcacatacctactctttaagatggagtgatgttacccagagggaccacctacctggaaaatggcaaagcctggccttgaacttctaattcctacttcagggcactttcttctgtctaaaataaaaccctgctcattatctgtgtactttatttacctttccaaatgttactattattattaatattattattataaccaagttatttagattagccaacatattttactgaggtgacatggtagaagcaaactcaaaactgtcctttgggctgcctccccagtccagggcatgcacagttgtggacagatcatagaagacagcttctctctgaaggtatggggttaggagtggggatgagggaggtccaggacaataagagaaacatgcaactgctgattgagtgtttggaaaaatgaaaagtattgctcactgattgaaagagatgtagtcagaatttcatgcttaagtgcgaccaattctggatgtcatggttgtcacctaatatgtgcccaataaacacatgttgactgaatgaataaatgtggggtgaagaaatacaaagcaaggagagcaagccaacccagaatcttccttgactttctgtgtgcctcctggaatagatgatttaacacctctgtgtctctaggtagaactgaaaggtgtcagtggcagagtttatggatatctaccttgagatgctatttagaggagtaggttttgtatacctggaaggtgaaaaggaagatctagtaagttcaaaagagggagactttggagccaacaacttaatgggacttcagtctgaaccacggcaaaggggcagccaagcctgtctggatgcctcccttgcacaacatcaacacacatgtgcccaccacagtgagggtcctgcttggttatctggcatgttatgggaacagaggagtcaacactttggagtaagtcagtgttagctcgtgttgcttcatttttagagatgagtaaaaagatgtgataactgcagtagcttcctataactgctgtaaccaattactacaaactcagtggcttgaaacaacagaaatcaattctctcatagtgctggaaacctgaaatcaagaatcaaggccagcagggctgtgctgcctcctgaggctccaagggagactcaatcctggcctcttccagcttctgtggactccaggcattccttgcccactggctgcatccctccaatctctggctccatcaccacacggccttcttttctctctgtgtttctcttctgtgtgtctctccataaggacacatgccattggatttagggcccacctggacaatccaggatgacctcattatgagatccttagtcacatctgcaaagaccctttttccaaataaggccagattccagggattgggacatgagtatatcttttgggagaccacgcttcaacctactgcaatgatgctgatgtattaggaagatggtttgacagggggagtgtgatagcaagggtagggtgcagacactgggctcactggctgctgtggccttagtccaggactggggaaataaggaacgaccacagcaggagccatgggaataaagaggaggaaatggaagcaggagatatttcatggaagaatttgccagaacttggtgataaattttggtgtggtcagtaagagaaagagaaaatcctaatttgacaccaaggcatatttccccaaaatatgtgctacagaatgctggatcttgggatatcagtagctattgtgtgaggggaaaatggttctatacataaagacatttgggggacactggattaaacagcattgaacaggtgtctatcctgcaggatttctgtaagcctttaacatccccacgtatatcataagtgtctaaagaaggtttctagaggacagtctttcccatacttacttgaccataggcctgctttatctagattatcttgaagaacaagtggtccacacacctctgaaaaatactgctcgatggcatccaccctctgagaaaagataatataagtgacgttcagaaagatggaatgaagaaaactggaatcggacagtctgatgagggccaggcttgtttccaagacccctgccagccttaaagatagccacagggactgacaccagtaactggcagctggcagaagccatttgcaggtttgcacagtgacgctctgactttaatagtccgtgcaactgtcctgtggtttggtttcttatttctctggtaccttcttgacagtagaagctgttgctttagagcagttgcagcaagtatgtttcacccagtgtgccaactctgctgcattggatggctgactctcatgctgccttgagaaggatgctaagctgcaggaggctgcgcaggaaagagtgctgtaaatgacttgtaatgtctgccatgagcacaggaggaagatggagatgagctaagagcccttcttggtttatgcctcttttttttttttttttttttttttttttgagacgagtctctatctgtcacccaggctggagtgcagtggtgcagtctcagctcactgcaaactccgcctcctgggttcatgccattctcctacctcagcctcccaggtagctgggactacaggtgcccaccaccacgcccggctaatttttttttttttttttttttgtattttttagtagagacggggtttcaccgtattagccaggatgatctcgatctcctgaccttgtgatccgcctgcctcggcctcccaaagtgctgggattacaagcgtgagccaccatgcccggcctcttgctttatacttcaaagaacttccttgcccatgctccctccctcccttgtccatgcctcaaaaggggccaaccaagatcagcagttatgcatcttggatgcagtcttcctggactcttcaatcttgagctctcacctagaaggaaaatggtggtatcaatgagagaaatgtagccatcaatttcacaatgaataataaaaatagctaatatttactgagcacttattatgcatcaggctccctgctaagtgttctacatgtaatgtctcatttaattctcatggcagcctcaagggataggtaccatcaatcatctaattgtacagatgaggaacatgaggcacatagagattaaattactagcccaggaacacacagctaatatgtgctacaaccaggatttaactttaagcatcctaatgttaaaaccgacactcataaccactgaactgcagatttaattatagacatgttggatttgaaacattggtaagacttgcaagtggaaatatgcaggaggcagaggaagatacagaactggacaaggtcaggcatgggcacagagccagggagtgggggtggttgaaaggtgcccacagatgcgtttattcaaactatgagttgagagtcagttatacagatgtacaatgtacagagaaatctgcgcaaatgttttatgtattagggagatgttttcccaagtaatgagttagaaataactgacttttgttatggtccatggacagaacattccaactgtgaggaaacaggacgcagatgaagaagtctgtgtcctaaatcatgctgaaaagtcagaatctgttgggatttttggagatacattctttgcatctcatctcatctcaatggtctcacaagtgcaatagaaaatcatggtccttggtgagagctggtgagagctttgccttagcatccccagctacagactcaccacctttcccattccctgtagaacctgaacccctcaaggacagggaatgggtctcattcatccaggagcttctaacacccgacacacgcagacactcagtaaacagtaagtgaattagtagaaccaaggaaataagaaccgaccctattcggttacatctgctcctggatatattatcaaatttagagtgttttcactgacccatcactatttcattgtaaatggctgaattttccccctgtaggctggggacaatgccacaataaattactgcctacttgaaccgagtttcattttgttctgattgattgccggtttcaaggaccgtctaaaatctcagtttatggactttacttcctggtggttcccagagagaaatgagcctggattccagagaatgcaaatttcttcaaacttgcagccggcttccagactccctgcaaaggtctcttaagcctctaaatatttcctctcttaaatcacacatcactggcacaggcagaatattttccagttacttctttcttgttaggagagagtcgcttagaggtctaccaagtagacagaaatgcagtcgttttggcagttttattgtgctgtctttaggtttcgtttagtgattctttttttaagttgtgtttggttttttattcctgaaagaaactatttcaggaatagttgcactggaatattccaggaatagtcgctgcattagaaacacgatgttgactctctcttggcatgtttatgggtgggatgaactgcatatgtgaaatgaagcttaatctctcacttgtgcaaatgtcgagactttgatttgacacttttccaattaggtgatgtgaatccctagggctagtgtggtagcttattgtgtagcaatggcacacaggtattctgccaaattttgatgtgtatctaaaatttgtatttgattcaacctagaatagattctcttatagtgtctgttggacagtatgctgaactgagcaagttatggagtgtggcacagaatgaggcacaatttatggtgccatagctaagaggcacagtgtcatgtcaagttagtatgtatgaaaaatgaccattgccttggtctgaatcttccccaaaattcatgttgaaacttaatcaccattgcagtcgtattaagacgtgggtcctttaggaggtgattaggtcatgaagactcctccctcataaatgggattaatgccttataaaatagccttcacccggggttcagccttttttgcccttctgcctttcaccatgtaaggacacagcaacaaggcgccaccttgaaagtagagacggggccctcaccagacaccaaagctgctggagccttgatcttgaacttccagcctccagaactgggagaaataaatttctattatttatagattactcgttctcaagtattttgatgtaacagaaaactgactaagacagccatttattgaaacacacaaactcttctctgatgaatacaaaaaggcttgtggtcagggcaataaataattctcaaatggagggcaacaaaagtgaaaaatgtgacaacagaaggaagtttttataacttcccaacactttctttttcataatgtattccccattaatgcccttcaaatgtatagccaaaaatttgagtgtttgaaagtgcaaaaaggttgcaaaccactgatccattcccgacatcatcagttaggttctgacacacatacacacacacagcactttagttaatgttttttcttttggattttctttaaattttgctgcttttcttcattgatgttactcagattttgttgattttttttccccatgtttatcctcttttttttttttttttttttttgagacagggtctcactttgttgcccaggctggagtgcagtggcacaatcatggctcactgcagctttagcctcccaggttcaagtgatcctcccaccttagcctcctgagtaggtaggactaaaggtgcacaccaccacactcagctaatctttgtattttttgtagagacagtgtcttgccatgttgcccaggctggtggtctcaaactcctgggctcaagcaatcttcctgtctcagccttccaagatgctgggattacagttgtgagccaccgcaccaatcaatttaaactcttcatgtcttgcctgatatatcctaggtataagcctaagaaaattgccttaagtaagactgaacagtgccttggactctcttgctctcagacaaatacccaactttccagagtgtttattattgaaaaccacaaaagttgaaaatgggagacagctaacttggaaactctccctcatccctccatctctgccattgtcagagtcagtgataagaatgagaggtaaatgctcttgcccatgtatcgtacttttgcagtggatggggtccttgactctctgagagtcatggcccttaagaacatctggagcagccactgaggactttgtcagcaacttctcattccaggcaacaacccacagtggcagccagcagccctcagctccgtgggaagcagtatgggggaagtacgtggacttggatagcactcaaaccaaagtgtaactcattactactgcaacctttagtagagttgtccacttctgtgagcttggtctcctcatctggaaaatggaaataaaatttctcccccgtggttattaaaattaaataagatgtctgtcaggcatccttatagaggaggcactgtataaaggttcttttccttgcctccctgcatcccataatgtaaacacaacctccctcactggctaccttttgttactgacactggaatatctgaaaatcaactgatagagatgatgagacatgcttctttcacagattcatcagatttcctgactggccttagatgaagcaggagcagagggggaaatcttgatctgtggcaggtgtttaggtttcatggatggtaaagagtaagtctgagctatccatgatcaatttattactaatacacatcacactttcatataacttagataacagctatgaactcacttctttggaagatcctgactgctatggcaaagactctttcgttgtctgccaaacctgagtctctttcctcctgggtccatagctaggccgtatttcccagccttcttgaagttggatgtagccaatggaagatgggccagtcctggtgattctccactttttcccctctccatctgccaggtggatatcagtgtccagtgcaaccttggaaaccatgtattgaggggcatagagcctctggcagcctgggtccttaagtggttgtgtggagctttaccctccctgcccaccatctgagttttaccctagcaagaaataagctcttcatgttaagccatggaggagttgtcaaggttcatctgttatagcagctagctttgccttaacgaataaacttgatgaaacaggaggtgagttttttaaactttccccttttatgatagcactgacattcttctgaacattttctatgttgttactgtgggaaaacaaatgtcataattacttatctattcaaaatatgctgtgtatattgatcataagaaagatggaatgaggttctctgtcagcaggaagtctatttgactttttacctaacagtctcaattgaaagctggggttagtgattaactacacttattgtgttttcaatcagattaaacactcatggtgccaggtgctaggttgagaaggggaagcttagtaaagacagaagaaataaaagtaattttttttctaaatagtcagaaatccagaaattagacaatcatcaaagatttgtctaacgtatcctatatacttttatgttttcttgaacaaaatgtactgaaaatagttttaccttttccagccttcagcttcatcaactgtaaaatgaaggatacttaatctacaggatttgagaattaaatggggatcatagctacctcccagcctaatgcctgacgtaataaatattaaaaccctaccctttcttaatgacctggtttgttgggatatgctcgggagttatgcttatgaacatgaattatcacattggagacttgtaaattatctgtggctgcttatcccaacatggaatggtgctaggtggcagtgcttctgttatggtaactacttctacaatttttattgatttcttcttgccactttttgcttgtagttgcagccttcaaaactatcttcttctaatcctttttattgggggaagaaaatgaaacacccctgttagaaattattattggaaaatgaacgagttctgtatgcaagctggaagacactccagccaagaagactaccagccgaatggcagttacagcagctcaggggccagcacactcagtgccaagattggggctggttccagcaagttgaggttagcagcagtcagaactccccagttcagtatggtgctgccacacttcttgccagctcagctcctgtggctgggagaaagcggggaggaaggaggtaaagatcagagattgaagcaggacaggatatccagggtcagatgtaactttagtgattcttcattgaggaggccaagcagtggtttttgggtgtgagtttttatgacacactacttatttggggctaaatatgacatgcccacgtatttaaaagccccaatcattcattatccagcacaaagatggtaatatacacatctatttaatatggtatcagctgacatctcagtgatttgaggaactttagaaaggatctgtcctccaaaatatctcctcatccagtttgccttgattaaggaatctcaccctgaagagatgtatcccttagggtcagtggagtgtttgctctctttcactcatatggtcaccagaaaacatgggttgatacctactgtgtaccaagcccccgaaaaaaaaaatctttgcctctgccttcaggaatcttactgtctacttgaagagattattacatgagaaatctgtgctgtggatgaggaagggggtctagaaagtgaagtacaggggcttagagagaaattaaatggggggcgggggcattgacggggataggggcaggggtgctaacttagattttgagtcagaatgcctctctggaagaatgtgcttctatcagagacctgaaggagtggtccttggccaggcaaaagaagggatgagtttagagccataggaaaaaatgagtgaacatttgaggcaggaaggagctaggagctagagggagaccagagggtcataaggaaggggctggggagtgtgggatggggctagatcctgctgggcttctgggcctggctaaggacttcttaaattcagacctaaggacttcctcattcatcctacaggcaataggaaacgcctgaagtaataaaagaatgacctgtttccgctcttgttttaaaatatcattctactcaagatgtggaaattgtgttggaaatagacaaggtagaagcccagagatcagttaggaagtgactgaaaaaaatcccgggaggtgcaaggccttgaacttgtggacacatgaaaatggatagaagtgggtgaattcaagacacatttcaaaaatgcagtcagtaagattcttctactgcattgtggttaagcacctcggctgtggagacagacgccctgggtttgaatccctgctttgctgcagacttgtcatgtgatcatgagcaagtcacttaacttttccaagccttgacctgacctgtccactgggcatgttatttaaaacagagaatacactcgtggtctcttaacacagtgcctagtggcacagatcaagcactcattaaatgttgttcttttgttgaaatgcagggagaggtaacactacaattcagttatcacttaattagctctttgttctgagttagtctccccgatattttccagctgccaaataagagaagcagaaactgggcagaagacgcctgaattctgggtggaggaagaccagggctgcattagaatcccttgtgaacttgaaaaccatcagtgtgtccccctcttcatgttcctcttctccagctcacccataaccccagtcttaagcttttactgcaaggtcagtttttccagttttttcccgtactttctccaagtcctcagaaatttctgtaagtcctgcagcctaaaatacagtccaagccatgctgaggagtaagtaaggttacactgttgtgttaatctgccatgagcagacatgcaacggtggtcactgggacctttggtgcttattctatagccttggcctagagggaagagagacatgacccagaagggtaacagccgtcagcaatgccaacactaaactcttagcactgactgaaacaacaaagggtgagagagagagagagagagagtgtgtgtgtgtgtgtgtgtgtgtgtgtgtgtgtgtgtgtgtgtgtgtgatggagtctcactctgtcaccaggctggattacagtggtgccatctcagctcactgcaacctctgcctcctgggttcaagtgattctcctaccccagcctcctgagtagctaggattacaggcacatgctgccatgcccagcaattttttttttttgtatttttagtagagacgaggtttcaccatgttggccaggatggtctcaatctcttgacctcgcaatctgcccgccttggcctctcaaactgctgggattacaggtgtgagccaccacatccagccagggtggaattacttaatgtagaatttatcttgccacatatttgttaaactctttcaccagagtgtttggtgctggctgtttataatatagatgtttgacaaatctcttaaaacatgcaaagccattttctttctttcttttttcagaaagtaataatcatctctgttctattcgaagcagaaaattatatttaattaagtaaaaataagattagagaaggagtgtgttgaagacccttggaagaaaaccaatgagttggttggctctgtcattttcccactggtaatattttttcagctccactggtgggagttgtaaagttttccatttaggcagagagtgaacacctttggtcatggaaagaaagccagtccttttgagatattcacttgccatgtgtgtgccttctgaagtatgagttgtatttgctgagcaattgagtcttccctgggtttctgggatcaggtgcctgcagtttgataaaataacctctagatggagcttttgcaccttttggttgagctgggttgcccgtggggcaaatccccggtaatctgagcaggatcaaaataaacttcgttactccttcttattacgtaagtattgtgtgtttgtggtgggaacactaggaaatatagatttgcaagtgggagaaaataaaaatcaccgtgcagaggtaaccagcattaccatgctggagaatagccttctgatcactttttctgtgtgtaatgaaaatggtttcatcctcgaaatccccttttgtaactttttttcacttagtaaattgtcacatcaatacagcatacaccaatcagtgtcactaaatattacaacaccttagttttataattaaagagtatctcagaacatacagtaagatgtatttaactcagaccttgtgattaaatgtttacattatttaagatttttcaccattatgaacaataccaagatgaaaactcttttttagacaaattttggctcatgtccacgattctcagagatggaactggtgttcgttgaaaatgtatgcattatgaagtccgctgatattgcctgcttagagcaggactcccacctgactagtaggagaaaatttaatcacaagggtccttaaaggtggaagaagaccaaggcagatgagggaaggttgtgagaagaactcaacctgccattgctagctttgaagatgaaggggagacctactgatcgggtaggagatgtgctctaagtaggcattattggcaggcttagtaatgcatatattttgaactaaaataaccccaatatcattaggggttattggaaatccaaagtctcaggccccatcccagacctactgatttaaaatcatgttaagatacgaagtgatttgtatacactttcagagacagggtcttggtctgttgccctggctggagtacatcagcgcgatcccagctcaccacagcctcctgaatagctgggactgcaggtgcacacaacacacttggctagcttttcaattttgttgtagagacagagtctcactatgttgcccgtgctggtctctaactcctgggctcaagcaatcctcccacctcagcctcccaaagtgctaggattataggcatgagccacagtgcctggccaaagcccaactcttaaagcacctgtattcatttgcagtctcaaccctgtgtcagactacctgtttccctagactcttgccagtaatgggcatttatccttcataaaaattattttccagatgaacgtagcaacgtgttatttgattttgtgtatctttggttactattaatgttaaattggttttcgtattagagtctcatattgcatttgtgtatcttcatttgtgaactgcctattcatggtcattcccatttttatcatttcactatttttccaaatgagaataatttttgttttgttactatatttttctgctcactgtaaaaacaattagaaaataacaaaattaaaagaatgtgatactcaccttttatgtttgctcaaaataaaattatattaaggatggcattttatggcctactttttaaacagcatattaagatacaatttatggccaggcacgatgtcctgtaatcccagcactttggtaggccaaggcgggcggatcacctgagttcaggagttcgagaccaacctggccaacatggtgaaaccctgtctctactaaacaacaaaaattagccaggtgtggtggtgggtgtgtgtgtttgaggtatgagaaccacttgaacccgggaggcaggggttgcagtgagccaagattgttccctgaactccatcctgggtgacagagcgagactccgtctcaaaaaaaacaaacagaaaaaaacaggtataatttatacatcatccaattcactgatttcatttttttagtatatttatattcacagggttgtgcaactctcaccatagtataactttagaacattttcatcactcccaaaagtaatcctatacccattagcagtcactccctatttccgctcaccctcctcgggcctgtgaaacaactaatctactctctgtctccatacatttgcctatactggacatttcatataaatggaatcatttaacgaatggtcttttgtgaccgacttccttcacttaatatatcttttcaaggatcatccattttgtagcatgtatcgatacttcgttgctttgtattgccaaactatattctgtagtgcggatataccacattttatatatatctgttcattaggtgatggatatttgagttacgtccatttcgggggttgggctatcatgaataatgctgctacgaacatgtggacatatgttgtcatttctcttaggtatatatctaaaattggaattactggatcatgtggtaattctacatttaactttttgatacagctgcagacttttccaaggcagccgcaccattttacctgaccactagtagtatgtaagatttccagcttatccacacccttgccaacatttgttatcacctgtgtatttgattagtggttttgatttgcatttccctaatgactcttgatgttgagcatctttttctgtgcttattgaccatttgtatgttttttcctggagaaatgtctattcaaaccttttgcccatttttaattgagttttcattttattattaaagtataagaatacttcataggttctgatacaagtctcttatcagacatgatttgtacattttttctcccattctgtggattgccttttcaccaacttgatggtatcattagcagcaccagggtcttgaattttgataaagtcccatttatttatttttcctttttcacttgtgcttttggtgttacacctataaaaccatcacctaacccaagctcatgaagttgctcctgtgtttccttctaagagttttaaaatcttagctcttatagtcaggtctatatattagtgtcctatggcttttacaacaaattaacaaatttggtggcatcagataacaaatttattatcttacagttccagagatcagaagtccaaaatgggtctcactagactgccatcaaggtgttggcaaaaccgcaggccttgtggaggctttaggaaaggatccctacttctggctctttccagcttctggaggctgccacattccttggttcccaggtccccttcatcttcaaagcctgcaatggcaggttgagttcctttcacaaccttccctcctctgcctggcccttccacatttaaggaaccttgtgattaattgtgcctaccttgataatctaaaataatctctgtattttaaagtcatcagagtagccatgttaattccatctgccaccttgttttccctttgctatgtaatgtaacatattcacaaatttcagggattaggacgtggacatcttggtggagacattattctgcctaccatgatctatgatttatttgtttaatggacaagtaaaaattgtatatatttatggtgtgccacatgatgttttgggtttatgtacacattgtgactgagtaaatcaagctaattcacttatgtattataagaacacttaaaatctctcttagcagtttccaagtatataatatattattattaattatagtgaccatgatgtagaatctttgatgtgttttgagttaatttgtgtgtgtatgtgggaggaagtaggggtctatcctcattcttttgcgtgtagatatccacttatcctggcaccatttgtggaaaagactattcttcccttattgatgtagcctacttttgtcttaaaatgtaacatcaaaatgttgttagtatcagcagtcaatggcatggtcactctaaaggattggataggagttcactttttggatataccatagtgtatctaggacctcccctacggttagacattgagtccaacctttcacagttaacattgtctttaagggttttgtgtttttaaaaatatattgtggacctgagccctttcccactataaatgttgtcaattatctttgaaatcattcacttctttccaccatcccagtttaagctcttagcccttttcatctggactacagccataatcttctaactggtcttccagcttccattcttgcctccctctaatcccttcgccatacaacagaagtagcctttgcaaaatgcaaatctggtcctataactgctgcccttgcccttaaagtagattctcattaagagaaagaaaaaatctctgcaacatggcccctccctttgtcctcagcccatctgatactgggctggctcccccttggttgcttctattcagccatacccccttcctctcaagtcatcaggaaggcaagtattgctcctctcacaagccaatctctctaatgaggacaatctccctatattaccatatatctttcctttgtaattcttttcacattgcaattctaaatgtatttgttgggtttcattaatgttggcatcctgcaccagacaaaaagttccgtaatgataagaattgagtctgtttttcctggttcaagcagatgataagtactgatattttcagtaaatggacaagtgaaatacattctctactgtgtatttggctttaaaaaaatttttttttatttttttatttttatttttgagacagagtctcactctggcccaggctggagtgcaatcacaatcacgtgttctcgactcactgcaactgcctcctaggttgaagtgattttcacacctcaccctcccaagtagctgggtttacaggtacatgccaccatgcccagctaatttttgtatttttagtagggatgaggtttcaccatgttcaggctggtcttgaactcctgacctcaactgatccacctacctcggccttccaaagtgctgggattacagacatgagccaccgtgcccagcctatttgtcttttaattctgtttatgatattttcaacttacagaattttaaaatatatatacaaatatataaatattttcttttgtgtttttgtcttcattatagctctgcttaaaaatccttccccacattaagaatatagaaatatagacacatttccttttacagttttcatacttccgttgtttgcataaaacctataatccacctgcaatttattttgtcattgatataaattagagaaataactttactcctcaagtggctggccacattcccaaccctttgccttcctttccttgatgatttgaagtgactcattgattgcacacgaaatccctctacatgtttagtcaggtaaatgatctgtctcttctgtcgctggttgtttttgccactgttttcattattacggcttcgtgctatgttttagtatctgacagttaccttttgtaagaaaataagatttcataaaataatactttgtgcaatttgaattaaggttttctagacagataattattgcttgaagcagtggttcccaaaccagcaggcatccacagggcttgttataacacaaatcaatgggcttaacccccagagttcctaattcataagtctgggatgaggcctgatagttgcattttaaaacaagttccctgatgatgctgatccagggaccatagttgagaacctctgccttagagcaaatacttgaaacaaagaatacagtcaacatgagaatggttccaatgcattgtctgaactagctcccctgtgtgctgtaagagttaggatgggcctgtatggtttttttgagcatctccctgattgtgtctctggcccttctcctggccccactttaaatccctgagcccagttgagccaagtaacataaccctcctttcagtgaacctgcaaggtgctcagcctaactgcatggctgccctgatagttacaagtgctgatccagccaggctttggcccctttcagatagaaatcagagaagggtaaggatgcagtgacttgctttgttgtagattctcatgattgtccttatctttgaagagaagggagagcaatcaccagaaatgcagcagagaactcttctttgctttcctcatttcccacctctgtggctctttaatggcttcttggttttgtacaaagggagagttaattactaacacctgcttctgcttctcctttcctgcatggccagctccctgactgatagccagctgctttcttgacaagagactttttccacctattccacacaatgtcagcatatgtaaagaaataaacatagtttgaacactttagccataccatatggacctctgtggagaaacctgcatcttccttcttccttcataaagaatacacattctttgcaggaggtaaaatagccttagaggtgacatctgctatggtttactcttctttattagtaagaggtagtgcacaattatattttacatgggatgtgtggttttaggcatcatatgttcattttccgtattttttgatactctcgtttgtaccactaacattttctctttttaggtcacccaaaagttaggttgaaattatttgaatttccttgaggaatataccttctgggaatttctcctctgcgttttctgttttctggtatctaagatgaaccattagaagacctcccgtcataagcagattagagtttgctataaagccctcctttgcatccgttctcttgtttggcattcattgaatcaggctatctgtgtgctgactcttggggccacagagaaaaagatgcatctcttgttatggagggctcactctgtattgatgaagacaacacattaattaacaattacaacacatcatgataaatattacactggagataatcagaggatatctggagacagaagccagggcagtgccctcagcttgacagggagcctgatgagatataactcctagaaaaagtgacatttaagggaatcattgggagcaaggaggacttgtgcatggcttcatttctcttcttaactattattacaaccattatttcattttatttacttttttttttttttttttttgagatggagtctagctctgtcgcccaggttggagtgcagtggtgtgatcttggctcactgcaacctctgcctcctgggttcaagcgattctcctgcctcagcctcccgagtaactgggattataggcatgcaccaccacgcccggctaatttttatatttttagtagagacggggtttcaccatgttggtcaggctggtctcgaactcctgacctcatgatccacctgcctcaggctcccaaagtgctgggattacaggcctgagccactgcacctggccgccttttttttttttttaaacgagtctctgtcacccaggctggagtgcagtggcaggatcttggctcactgcaacctctaactcctgggttcaagtgattctcttgtctcagcctcccgagtagatgggattacaagcacgtgccaccacactcagctaatttttgtatttttagtagagatggggtttcaccatgttggtcaggctggtctcgaactcctgacctcatgatccacctgcctcaggctcccaaagtgctgggattacaggcatgagccactgcacctggcctcctttttttttttttttttaaacgagtctctgtcacccaggctggagtgcagtggcaggatcttggctcactgcaacctctaactcctgggttcaagtgattctcctgtctcagcctcccgagtagatgggattacaagcacgtgccaccacactcagctaatgttcgtaattttagtagagatggggtttcaccatgttggccaggctggtctcgaactcctgacctcaagtgatccacccacctcagcctcccaaagtgctgcgattaccagcgtgagccactgcgcccagcctcattttatttactttttgaatagcaatacattcacatgtttgacagttcaataagtatgaaagggtatatagaaatgctgtccaccagtgtggctatttttctaatagccacattttaaaaagtaaaatgaaacaagtgaaattaattttaatactatatttttttaacccaacatattcaaaatattatttcaacatcaacccaacataaaaatatatgaatgagatattttacattcttttgcttataccaagttttcaaattgtatgaagtgcattttacacttacaggatattacaatttggaatagccgcatttccagtgctcagtatttgtgcatggctaagtggctgcagtatgagacagcacagatgtataataataaattttcctcgcatttctgtcctgaagcaactcagtttccctccctagaggtaaccattgttggtagtctccagtgtgttcttccacagatagcacatagacaagcaattataaacatgcatatgcaaataataggatggtaatcacacctctgagcatcttacttttttcactcaataaatcttggatatgtttcatatcattacataggaagcaaactcaattttttgttgttgttgcttcagggtacctcattttatggatgtcacaaattattcaattagtctctattgatgggcatttaggtggtttccaatatttggtgcttatgaacaatttgggctaagtttttagagacaaaaagcaacaggagctagctcagtgaggatgggggaatgacctttctagagaaagggagtaccaggaaagaaggtatggagcacaaggacacatggtatttgagataatttcttgtggcttaagatggctggagaatgaagtgtgtgtgaacacaagacaggaggaggaggctggaagggcaggaagagaacgtattgcaaacagtcttgtaattgtcatatgaagggatttggacttcatcccaaaggacactcatcaaaagattttaaggagcagaggagtaaaaataaatgtttgaattaataaatatatggaggaggcgggacaaatcatccatactgctgaattctggttaaatgcagaaggcatgagagaaacagaaaatcaccattagaacactgcagtaataattactgcaggcaagatctacagatgagtattaaaattagcagagaaaacaggacatttgcatagcctcaaagtatctcctctaaaatatttatgaatttgtgatggttttaacatatgttggaatattctttgatactccccctccaggaaggagatcttaattctatgggatttactgattcatttctaatgaataggctatggaaaaggaaaaatactatctttacagtggagaaacctggcagataccacctgaaccacatggtcaaggttaacatcatcagtggtaagtcatattgaaatagaatacccctgacgaatgtgataagaagggcattttgcttctatagtattcttcgtaaaaactcattaacccctgtctaatcatgaaaaaaacgttagaaaaaaacaaattgggccgggcacagtgtctcacgcctgtaatcccagcactttgggaggccgaggtaggcggatcatgaggtcaggagatggagaccatcctggctaagatggtgaaaccccatctctactaaagatacaaaagattagctgggtatggtggcgggcacttgtagtcccagctactcgggacgctgaggcaggagaatggcgtgaacccgggaggcggagcttgcagtgagccgagattgtgccactgcactccagcctgggcaacagagcaagactctgtctcaaaaaaaaaaacaaaaaaacaaaaaaaacaaattgaaggataatctaaaaagtacctaagcagtagtcctgaagagcatcaaggtcatgaaaaacaaagaaaggctgagaaatggtcacagaccaggagagaccacagaaatgtgatgactaaatgtaattgtggtctcctggattgggtcctggaatagaaaaagtacattttggagaaaaactggggaaatgtgagtctgtagtttagttaatattattgtgccaatgttaacatcttagttttcataaatgtatcatagttatgtaagatgttaacattgtgaagagatgccatgatattctgtgctgtctttgcaatttttctgtaaacctaaagttatttcaaaagaaaaaagttagaaaaaaatcaggagagtgacatgattggagtcacattttagaagatcccagtggctgcactgggaaagaggcctggaaggagaagagaacagaacaagaaggttgctacataaagtcaagaagagatgatggagggctggatgggagcagggcagcaggaatgtggggccatagacctgttggggagctctctagaaggaaactcaatcagacccaatgatggtttggatgaaaaagcgagggagtgggaagaccctgttgtcagcccctgggaattatatggataatgatgtcatttactgagatggaggaaacaggaggaagaacaggtttcagggaaacactagctcagttttagacctgttgaatttggagtacatttgaggaatgcaagtatccattaggcaactgggtatatcgacctacaggtcaggagggagacctggctacagatggttgtagagaatcacagatgtgggccgggtgtggtggctcatacctgtaatcccagcactttggcaggccaaggcaggtggatcacctgaggttgggagttcgagacctgcctgaccaacatggagaaaccctgtctctactaaaaaatacaaaattagccaggcatggtggtgcaagcctgtaatcccagctactcgggaggctgaggcaggagaattgtttgaacacaggaggcagaggttgcaatgagctgaggttgcaccattgcactccagcctgggcaacaagaatgaaactccatctcaaaaaataaaaataaaaaaagagtcatggatgtgtaaagcattggggccattggaaggataggatggcccaacaagggcagatagagaggagacagggcctagaatataggaatttaggagctaggcccagggtgtgtcaaggagtccagagcaatggtaacaaggcagtgctgtcattaagagtcaggctctggacaaaggcttttagggtcagaatgccgactgccacctaccgctgtgtgacatggagcaaattatttaataagactgttgtcatggttacatgaaactattttaaaagtttttaaaataattttagtaatactgggctcatagtgctcaacgaatgttggctgattagaggcaaaggaaatctagagccatagccctggaagctatggaaagagagtggttcaaacaggaggacatacgtttcacacccattaagatggttattgtcaaaaaagtggaaaataataagtgttgtcaaggaggtagagaaattgaaccttcatgcattgctggtgagaatgcaaaatggtgtcaccactatggagaacagtttggtagcttctcaaaaagttaaacatagaattaccgtatgattcagtgattctactcctagatatatatctaaaagaattgaaagcagggattcaaacagatacttgtacagccatggtcatagaagcattatgcgtaacagccaaatggtagaaacaatccaagtgtccattaacagatggatgaatgaacaaaatgtggtatatccatacaatggatattgcttaaccttaaaaaggaatgaagttttgatacctgttacagagtggatgaaccttgggaacatgctctgtgaaataagtcagacacaaaaggacaaatactgtagtgtatgattccacttatatgaagtacctagaccaggaaaactcatggagacagacagtagcatagaggttgccaggggcttggaggaggggaaatggagaggtagtgttcagtgaatacagagtttctgtttgggataatggaaaagttctagaaatgaatagtggtgatggctgcacaacattgtgaatgtacttaacgccactcaattgtatacttagtaatggccaaaatgataaatttatgttgtctatatgttaccacaatattaaaaggaggacatggttacagagaagtaaatgagttcttagtgattctcttttgaattttgtgacacaggggccattggtgacctttccagagcccttgcagtagagcagacaggtcaaaagattgcagtggattgaagggtgattgagaagtgtctagaccaggggctggcaaactactgtcaaatctggccgcctgtctgtttttacaaataaagttttattggaacacagctacacccattcatgtgtgtgttgtctgtggtttcctttgtgctataatggcggcgttgagtagttgctacttgagcccacgtggtctgtaaaacctaaaatatttaccatctggccttttacagaaagtttcccaacccctggctagacaacactcctggtctttcaagaactttggctttcttaaataattcctgcatttctcatgaggttactcggtagataactttgcccctttagttaggtagcagaacagaaccaaagctgaacagtaacaatgactaagaaggaggaagaggaaaaattcattcctttctttccttaactggagatattatcctcactatacctttttttctcttacagccctgtaaaaaggaatgaaagttcttccctccctgtcccccaccaaaaaactccccactggtaaatggtcatgtgactggtgataataaactttctgagatggctacgaactgcagttaggtttaaagtttcctcattaatgcaggaaaatgctcataacctgaggcttttcaagtgtttattaatttactttctggggctggctgctgatacttatttcagatcaaagagaaagcctgtgtctttagtagttactgtgtgccaggaactatgccacattttgtgcctaggtgagctcattgatagtcatcataaccataggatggcatttccctatttcacaggaggggagactagggctcaccagggttaaatactcacccagagacacacatgaagagtttgaagtacaactggagtttaacccacacctgcctaattccaggacctcagggtgtttccactgcaccgtgcagtcatcctatcctctgtggccaccaagagcctcagaatagcaccttgagcccactctaggcagaatacagtacttgatgggttctaatccattttaaaccatggtctctgctatttcaggataacaggtgaccatgtaaagtgtatctcaagtgcattgtaggctttaggaagacccttttcccagcctgctccccatgctcccaagccccactttgatggtctatgtgagtctactcagaggtagctcttatttctttaaaaccatcctgcatttcagtgtactctgacagcactgtctgacacttgggattcacttgttcccatgttaccacctatttttacattttctgcaataattcctcaagctcttggttaggcatagtgacccagggatgcagcaagagggggatataatggcttccacagttcccatccgtttgtgtctatacaactggtgcacaaacacacatcacccttgtgacttctgtccctgttgaggctgcccttgataatgcagcttttaactgcctagatttctgcaaccatcaaatcagatctaaaagggaactcagaagtcattcacccaacctttgtataagtgagaaaaataaactgcagcccagagcggactggcaacttgtccaggcaaacacagcttgtcagtcccagatcctggactaggaaggccctggctctccccgttcccagcccggagctcatcctgctgcaattcactgcctcctccctgcctcagtggacgaggtaggggctgtccccctgcatgtggcgtgcttaccttggaacccttttcatgaatgagaccagatgcagaactccacattgatcatttctgtccctcccctttctgctttctgttaaaggcagccccccagctcccagctggctcctgtcccctcccccagccgggagaagttattacatgaagagatcagcttaccagttttcttcagaacagaggctgagctcgaagcgccgggcagtacagtgagggagagccgagggaaccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagaggtaagccaaataaaatatcttgtcagaagttgtattttttttcagcattatatttcctcttctatctaccaagagggatcagggaatggaattttatggggtgcaaagagtaatgctttatattacttttgtaggcttctcttgccttttcttatatgaagacttcttttcttcttgaagaattttatactttctaaaatgtcattttgaagctgtctgtgcagttgccacactgggaagttgctctggccttggtgacagatgcctgtagcacgcacgcttctcctgctgtagcagaaaaaaaaaaagatgtgccatgtcagatttcgttagggactgttaccttttgagaatttttctccagtgctgcagagagaatgtacatgctaggggaattgcttttcttccctgcttttgcaacacttctctctttttttttttctttgatgtgcttagaaaaatctgtgcttaactttctatcatagatttgaagagggagaatgatatacaacagggctaggagtgtacccagatgtaccttagcagggagacatattttaagttcatgaggatgatttattattactggtttagttcatgtgattgttgggtacagtttttttttttttttaacatcagtgatacctcctggagtcagtttttgatgcaggcaaagagattgggatagatgatcattgagtccagagagggaagcaccttggtgtatccaccctcacctgcaaacaagcctgcaacgtatttccctcatccactcctttccctccttaccctgatgcctgagtaacgaaaggacagcctttctcctgcatccatcttcgtctttgaaaagccaaatgaaaagtgtatctcctaaaaaggccatgaggccacttcacagctttgccttttgttagccttgtcagggaccaagcaggctctgaaagcctaatgtaattactttcccttgtctaagaagagtggaagtgggagtgctcccaagcccacggctgcaaggctagctgtggtttcagcaggcttgttgctctgttcaaaacagacatgcagctcagagacatgcagcaacgggtcacttgttgtaggcttttcacttattagttactcatgtcctctgctctgtagacattttctgggcctgtggggggattgagcccttgaatgggagcaggaggaactgaatgggtgagtgatgctggaagctgaaagcagaccattgccctctagttgtagttgaagttcgcaatttccctgttgatttttttcgtgtgtagagtgaatgacaaatgggctggcctcactcagcctggagcatttaagcaggcgagaggagagctcatatggaaaatatttctatcaccgctgcatgcacatatggtctggggagacccccgaactgagcaaatcacagtgctccagcagcccctcagtggtgtgccaattattcttattaacagcaagcaaagggcaggctttagttacctgcacacagctgactcgtggggaaggccacgccggaatctgtgtgcccctagccttgtgtcacatgcagagtggcaaatggctctgcttcacctgacaatcagcaaagcagatgaaaaatgaaagggattatacaggctcacccaaatcttggtgcttttcagacagtgctcagcgtttgagagaggaaggcagaggttttgtcttatgagttaaaagtatgtgtgcttaacatgaatagctagaaaacccgatcagaggtagtgagatgcctgccctcctgcccctttgttccactctgctttgctaagtaaagatcctcttgggcctcttcctcttttctttcttgctttccctctttcccctagtgtgtgcatgtgtgtgcatgcgtgtgtgagtgcgtgtgtgtttctgtgctgttggctccagaacgcctgagctcctaggaaattatacaattaggattcctttttccttcttggaaatgaaatgatgaggaaggagcatgagtatgagtagcccccacctcttaaaaagaatgtagtttatatagagctttgaagaatgtggcatttatttataacagcctcttttttattgtcgtgttacttgcaaaacttacccataaacatgtggcgtcgtcactaagtcaccaggattttccttttctctgccagctggttttcttgcaggttttaattatcttccctttggatgttcctaaaaacacatgaggagaaggaagaatgggtaagaaagcgtcatacacctgggggcgcttggagggctgtgttctccacgtggggctggaagccaagcggcacactctgggaagcagtttacagtcagttttctagggtgtgaggtcctttcagataagcaggacctggcaggtggggagaggagggctgtgatgcaaagcaagccttgtttggcgtcctgtggctggcactgtcagtgctggtgactgtggtccaaggacagaacaacctggtatggtgtcagtgcatgggttggaggacagacacagaaaagaactgtgccttctttaattttcccattgccagagcattaaactcagaacagtgagatcatgagaatcccttttgtcttagtcaaggttagggtggcagtcgtgtacacttgtacagatggggcgtatccccgaaaagactgtaaaggacttttaaagtcaagctggacttttgaggcatttgtcagcgtggggagcgtgccaacgtgcagcttctttgcaggatgcagcagaatggcggggaaggggaggtgggaatgggaggcttgcattttctttcttgaacttggacttaccttctcagataagaccaatgagacattgttatatgtagggacagggagggagatgcaactagaaatctgctacattccatatttggaataatatgataaattctgcaaagtgtggtcaaaaagatgttctttaattttcttatttttgagacagagtcttgctctgtcgcccagactggagtgcagtggcacaatctcggctcactgcaagctccgcctcccgggttcacgccattttcccacttcagcctcccaagtagctgggactacaggtgcctgccgccacgcccggctaattttgtttttgtattttcagtagtgatggggtttcactgtgttagccaggatggtctcaatctcctgacctcgtgatccgcccacctcagcctcccaaagtgctgggattacaggcgtggatgttctttaattttgacggtacagtatggcaaaacctatcaaaatgaaaaataaatatcttagctgctgatgggtacagacaaggtttcttttcatggtgatgaaagtgtcttggaattaggtagtggtgatggttgcacaattttgtgactatcctaaaaactactgaaccatatcctttaaaagagcaattttatggcatgtaaattatatcacagttttttacattaaaaataaataaatgtcttttggatccagattttccatttctaagactttttatcatataggtctactctgagtgtgtaaaatgttctatgagccacctgtcataattaggtcctttccatcctactgtcctagtgataaggcatgctgtgcatttattcagaaagaatgaggtagctctagatgtgtaatgaaatgactaccaggatatgcttttaggtaggaaaagcaaattgaatgtgcataaaatgctcccattgtgtaaaatgtgttatcgactataatcaccattgcaaatgctaccaagtgtattaaccctgtgctgaaaaaagaaaggtgaaaagaccagatctttgtatttgatgagcttatactctaaaaggggcacagaatacaaacagtgaatgatcatgcaataagggtctctcattaattgcaagagcaatgggaagctacctaagaaagcaaagaaagattccacaaatgatgacatatttgaactgaggcttgaagggctgtgtgttgggggtcttcaagataacccctaagattcaattatctgtcgtgattcagtgacttagcatacattggcaatcacagctatgatttattacagtgaaagtatacgaagaaaatcaacaaaaggaaaaggttcctggggtaaagtctgggggaaacgagatggaagctcccgaggtttttttttcccagggaaggcacgcaggacccacttacttcccctagcaatgggttatgacaacacatgggaaatgttgccagctaggaagcttgttagaggcctagagcccagcatctttactggggctgaccacatgcacaccctctgcctgccagctaacaaaattccagactcccacaaggaaagcaggtgttcagcataaaccatattgtctatacagtagaggcgcagcaagcaagccacccttaccagttctgggaatgatgggaaccctccccaaatccaagttaccagatgccagcctagggccagccttgtaagcagatcttttcaaggagagcagtcaggtctgcaatcttaactcttttctgatggataagtaagcactttaagtgggaaaagagggggagcattccaggcagagggaaaacatctatagagccccagaaataagaaaggacatggcatgttctggaaacaatgcatagttcagatcacagaagcatccattgtgaggggatgtggcgggaaatttgtcagtcagctcgatcctgagaactggagtttttctctgggcctatgaaagttctcaaaattctagatctacagtcttaagattatctttttatgacgtgtcatttaggtcatcattgcaggacattttcttcttcataaattatttcctaaggagtaaatcaaattaaataatgaatgtaggactgctttgtaagcagtgacaccctttatttaaaaaactagttgtcactcttcattcctagagtgttatttgtggcaaatagaaatgaagggtcaatgtaatgaccttaatgactatttcgtggtacacaattctccctggctttgcctttctttttctagtatctaaaatagccagtcagctatgtggaactcacttgctaatgcaagacccaagtttgagctttgggtcaatcacttgggtgaaaactcaccatatgacttttctcatttaaatgtttttgttgttgttgttgagacagagtctcaccctgtcacccaggttggagagtagtggtgcgatctcagctcactgaaacctctgcctcccaggttcaagagattcttcggcttcagcctcccgagtagctgggattacaggtgcccgccaccatgctggctaatttttgtatttttagtagagatggggtttcactctggtctccaactcctgacctcaagtgatccgccctccttggcctcccaaagtgctggaattataggcatgagccaccgcaccagcctagcaatttttttacattataaaaactattgtaaaaacaaattcaagcaaacaaatacagagaataaaagttaaaggttcttctttaccctcattctctcccctatccttcttccctgccaagatgaaatcgttgttaacaatttagcatctgtccttctagaaccattcttgtacatttataaacgtaagggtatgtgcctatgtgagtgtctgtgggtttatgtgcatatgtgtatgtgtatgcctatgacttgcaatggcagagtttttccttcttttctgatacctgtgcttcttgtttctacctcatgtctaactgcatttgctagaacttccagaatacagtactgaataagataaatgaatgtgaacgttcctgtcttctactagacttttttttttttttttgagatggagttttgctcttgttgcccaggctggagtgcaatggcgtgatctcggctcactgcaacctccacctcccgggttcaagcgattctcctgcctcagcctcctgagtagctggaattacaggttttgtgccaccacacccagttaatttttgtattttcaggagagactgggtttcaccatgttggccaggctggtctcgagctcctgacctcaggtgatccacccgccttgaactctcaaaatgctgggatgagccactgcgcccagctcttccagacttaaatgggaatgtttctaatatttcatcactaagtatgatacctgtcacagatttaggtagatacattttatccagttacaagtttatttctaagtttttatcaggagtgattgctgaattttatcaaatattgtttgcctttatcaaaatgctcatatgagttgtttccattaatctacttacatagtgaatatattatggatttcttaatgtcggactgtctttgcattcttggaattaactatcttaatcatgatttcttcattaaatttgctactgtatttgatttataaatattttaaattttttcttctttttaaataagtgttattggctctcggctgtattttattgtgctagaccagggttttgatagttttgtaaaatcaattctgaagtctttcatctttttgtatgctttgaaacagttttgttttgttttttcgtttgttttttgtttggtttggttttttttttttcagatggagtctcgctctgtcgcccaggctggagtgcagtggcacgatctcagctcactgcaagctccgcctcctgggttcacgccattctcctgcctcagcctcccgagtagctgggactacaggtgcccaccgccatgcccggctaatttttttttttgtatttttttagtagagatgggtttcaccgtgttaaccaggatggtctccatctcctgacctcgtgatctgcccgcctcggcctcccaaagtgctgagattacaggcgtgagacaccatgccccggttttttttgtttgagacaagatctcactctgtcacccaggctggaagtgcagtgccccaatcacgtctcactgcagcctcaacctcccaggctcaagtaatcctcctgcctcagccttccaagtagctaggactacaggcatgcgccgccatgcctggctaattttttactttttgtagagacagggtctcactgtgttactgtgttgcccagactcgtcttgagctcctggacccaagtgatcctcccacctcagactccccaactactaagattacaggtgtgagccaccacacccagcctctgaaacagtttaaacaaccaaaaagttaccttttttttttttttgaaggtttattgaactcaaccgtaacaccatccagctctttagtggagtgatggtatttgagtatctttttaaccatttattttatttcttaaaaaggcataatactgaatatatgtaggagaacatatgtaatatataagcaattatgaagtagtataataaagcaaacacgtatgaactcaccacacaactaaagaaatcaaaattcccagtactatgcaccactccccactcatgtcctcctcgcttctctccttgaaagacaaccatcaccctgaattttatggttttcacttcattgcttttatttataatataatcacaggtgtatgtgtgtctaaagaatatgctatttgggccaggtgcagtggctcatgcctctgatcccagcactttgagaggtgcttgctagaacttccagaatgcagtactgaattggcgggtcatggagaatgtgtttgtttaactctacagttaatgtcagattgctttccacagcagttgtattagttttcatttccactagtagaatgtaaaagttctcaatgatttatctcctttccagtattaggcattatcagacaggttaatttttactgatatataagatataaaatggtatcagtgtatgctaatggacatttctctgatcattaactattgatattgtataatgtttatgtgtatacatatcattcacgtttcctcttctgtgaaatgcctgtttgtatttattttctggttttaaatttagttctttgctttttcactactgatttaagagtgctttgtgtatcttgaatatgaaccctctgctttttattccatgtaatattttctccactttatgacttgtaaagtgtctttagctaaacagaagtccttgattttagtgtatttgaatgtatccattttatttctttgtgttaacactctctttttcttgtttaggaaattattgatcccaaggttatagacatagtctcctatattgctttctaaaattattgaggttttgcacttcacagttaagtttttatacacttagagttaaattttctgtatggggtaaataagggatctaatttcatttttcattaagggatctaattttcttttttccccatattggcaatgagttactacaggaacatttattgaatagtctttccctttcaacaaatttccagggccatttcttttcagtaccaagtttccatatatatgtctatctttttctggcctctgtatttgctccattggacatttctatgtctgtacaagtaacatgctgtcttaattactatggccttataataatctgtgtagggcaaatcagttcgcattattctttgggagtgtcttagttattcttagacatttgctcttccttatgaaatttgaaattatcacatcaattttccttgaaaaatcatttaagaatttttatcagtattgtattgagtctatagatcaatatgagaacactaaaatcattctgacattgagccattctatccatgaacatagtgtataagctttacatttaattaagtcttctttgacattttctaataaagttttacaattttctacacaaaggtcttatacatctttattttatatttaatcctaggttccttatttttattataaattatgtgtatgtttttctaattaattttttattttggttgctaatgcttagaagtccaaatgatcatctggccatggtggctcatgtttgtaatgctggtagcactttgggatgctgaggcaggcagatcacgtgagcccaggagttcgagaccagccctgggtgaaacccgtctctacaaaaaaaataataataattgaaaaatagaaaaaatgttagctaggcatggtggtgtgtgcctatattcccagctactgaagaggctagggtgggaggattacctaaacacagggaggctgacgctgcagtgagccatgatcataccgcttcactccagcctgggtggcagagtaagaccctgtcttaaaaaaaaaaaaaaagtacaactgatgttatatcaaaacagctttctaaactcttattaatttaaatcagttttatgtaggaacttttgtaatttctagtacataattatgtaatctgtgaataatggccattttggcttttttccttttccaaattcttgtatatctaatttcttttttaatggccattttgagtttgtttcttttccaatttttataatttttatttcttaacctttgcaatggctagaacctccagcaaaatgttgaatgggggcagtattattttgttcctgatttgctcaagagaacacttctgacattctgccattgaaaatcaagtttgctgtaagtttatgcttgtattagctcaataaaccctcttctattcccagtgtactaagagatttattttttaaatcatgaacatgtgttgaattttatctgacacattttctctattaagatgatcatttggttttacttttttaatctgtcagtgtgataaattacagaaacagattttataatgttaaactatccttgcattccatggataaatccaacttggttatgatatatttctatttttattaaattaattttataacatgactatttttaagagggttctttaaaaaaatatatatttgagagtgcctgtaaacttttctttcttatggtttactttcctgttttgctataaggctataccagtcttataaattcatttcagaagtactgccttgttttctaatgtctggaggattttctataatataaaattattgtaatttattcctagaaagtcacctaaaaaactggctaagcctgatgtgtttttcccccacagggaaattttaaaccaccagttatttttatttaataattataggagtattaaggctttctatttattcttggaaaatgtttaaaagttaaatatgtctaggaatttgtccatttcatctacgttttccagtttattaacataaatgtgttcattataccttctaattatctacagcatctgcagatctccaggtgctgcagagcccttttttgtttcctaatattgttcaattgtgccttttattttattaaccattctttccagaatactgtaaattttactaatcttcataaaaaaatcaacttttggctttgttcttcctcttcattgaagctttgttttctattccattcaattctgctctttccgcgggtttatttatgtcatcatttttttctttaactttagtaacttttaaaatttatgtgggccgcatgtggtggctcacacctgtaatcccagcactttgggaggtcgaggtgggcagatcacttgaggtcaggagttcaagaccagactggccaacatggtaaaaccccatctctactaaaaatacaaaaattaaccaggcatggtggctggcatctgtagtcccagctacttgggaggctgaggcaggggaatcgcttgaacccaggaggtggaggttgcagtgagctgcgactgcaccattgcactccagcctgggtgacagaatgagactctgtttcagaaaaaaatatatgtgtgtgtatgttcagctcatttatttttagcctttaatctgttctaatgtattaaagatggcaattttttcttgtagtgttacttatgttgcatctcttaagttttgatatacagtatttttattattagtcagttttaaggtttttttgttttgttttaagacagagtctcactctgttgcagtggcaggatcacagctcatacagcctcaacctcctgggctgaagtgatccttccacctcagcttccccagtagctgggaccacagatgcatgccaccacatctggctaattttttaaaattttttgtagagatggggtctttctatgttgaccaagctgatcttggacttctgggctcaagcaatccttccaccttggcctcccaaagtgctgggattacacacgtgagccactgcccctggcctcagttttaaatatttttaaaatttttcattatgatattttctctgacccaagcactatttaattatatttttaagtatggagggtttcggtgtttttttaaatttgaaattaatttctaacttgattatattgtggtctgagaatgtggtatgtgcgatgctgatttttctgagatttgttgagacttgctttatggcttagtatgtgagcagcctctgtaaacacgccaagtgtgcttgagaaaaatgttggttttgatgaacattcttgataattggttcggagacttttatatttctattaaatcaaggttgtagattaggttgttcaagtcttctgtgtcttttctaatgtgcgctgcctcatctgtcagtattcgaagaagacatgttgaaacctccctccagcatctttgttggcctgtggaggggtggggcatggctgacctcagcattcttcaggcaatcctttccttgatgttagtggccactctagcttttgctcactgtacctgtggtttctgagtttagaattttttcatctctgcaatagtctgttttggtggtttcttctgctgtggtttcttgccaacataaactttctaatatccagaaattcctcagaatgttttatctggtaatcatatcctttcttgttttatagttgtcattacaacttgtgtgttttctgcgatttgaatggaattttgcaaaggaaagaggaaaacaaatacctttgctcaatctgccatcttgaccctacataagacacatttttatccttcttttcctcctttttttttttgcaataaatgtttattgggcaagtaatttttctagacctctgcttctctaccttcttcccataaaatgggaagaagaataatattcatcgcaatgacatataaggaacattaataagataatgttcatgaaagtgctttgcaaactgtaaagatttattcaaatgcaaaggatggcctttagttccttactttaactcactctccttttgtgtagccggtgttataaagcagctcagctacattagagaaaagtgattaattgtggttagcatatcgtgagaggctcaaacaaaattttattgttacttcttgagaaaatttattgccaagaaactattgaataccttaagagaaagtcacatatttaataaatgaaaatattatttagtctaaaaactaatgctacaatgagtatcttttttcctccctattgtcttatactatacttttgacatgcatactcaattaggcatttctcctttaaaaataacattttacttaaaaaaccttattttctgattcagcatattcaataaatttatttactttagcttagaaagttaatatgaagcaacagaaagaatgctgaaatttcaagcaaggcatttttaagggacaaaatgagtaattgatgtaaaagacagagtggtttatatcagaatgtattgaattctgcctgactacaatatttttcatattcctacattgcaccaaggcaaaataaacaattctgaattaaattcaacaaccatgtattgagtgctattttttgtgtcaagttttgtgctaagtgctgtggaattcataaagaggtgagacccaatctgccctctaaagacaggaaacaacaaataggttagtgagggctaagatataaattactctaataaacatatcacactcttttgtgagatcaggaacagcctatggagaaagtagcatttgagatgggattgaagaatgcttaggggtttcgtaggcagatattagaggaatgcattccaagtcatttttgtaaatgttctgtggaagcttgtaaagatgtactttccatttgtgttataaatatagttgtatataatacgtgtgcaattttccatgtaattgtatcatttcttttctctgtgtgggtatgctcttatatttcttaggttctactagaagtaactaaaattaagtgacttcctaagtatgttccagccttaacattatctgaatgtaggagtgaccactaaactacaaacacatatcataaaccccttgaatagagttgatgtcttttgtatagtgggagaaagtccatgagctttcaaacacacaggcctgagcttgactctctggttcttgcttaggcaggctacaagtaagttcactaagcatcattctctttatcttttttttttttttttttttttgagatggagtctcgctgtgtcgcccagcctggagtgcagtggcacaatctcggctcactgcaagctccgcctcccgggttcacgccattctcctgcctcagcctcccgagtagctgggactacaggcgcctgccaccacacccggctcattttttgcatttttagtagagacggagtttcaccgtgttagccaggatggtcttgatctcctgacctcgtgatccacctgcctcagcctcccaaagtgctgggattacaggcgtgagccaccgcactcggctctctttatctttaaaatgggaggatcatgtcaatatcgtagagttttagtgaagattaaggaggtgatttccgtaaagtgtttggtatgagaatatgctcaatgaatggcagctatcaccattattaaaaaattgatctctcaagcctaatggagaaagattctttatatagactaagggaattgtgaaatctgtgagtgggtatttgtccaactgaagtagaatgcaaagtgagaagaatgagagggaattaatatggagttgggggtgagggcatcacccatgagaataaaaagacaaacatgggatcctagagaggggaggtatacagtcaggaatccggagtgtagctccaaattccttaaccaaatctgatgacccacaggctccgattggagagaaaggagaagaaaatatgtaggatgctttaaaatggaatgacagagtgagcagttgagaaagaagaaagagcaaaaaccaggatttccaaagctacaagtgtccataccctcccaggtggagaaggaagggctgggaagtcactgggattttctcagcaaagggtggacccaggactccttttaaaataaacacacacacacacacacacacacacacacacacacacacacacacacacacacacaaacactcactcactctctctcttctctagagccagaaagtgatgttaagcaccaaattccagtgtcttgaatcattatttaataaggaacctcagagataatctagtctaacctactgattttacatatgaggataatgaattttttggaggttatgtggcttgcccaggaccacacagttgtttaacccagacctggagggtgaatggtctagaaacaaaataatcttcacacacccagttgtggcttctgagacctttaggcaagggaaagcttgggggtacttggaagagagtatttgtggttttaaatcagatacagtttaaaccaggtacattaaatgtgttcaaagctatttgtaagatacctcagctgtatagtttgttctgtcagtatgcttgcgctatagagatggttagttttgtacatcaaccatctgagtgtgttggaaggtggtaggaagggaagggaaggggtgaaaccatgcctcctcattaatcaacttatcatattatgattcatcaacatattatttgcagagagcctaccatgtgccaggcattattcaaagtggttcgcatatatgccgataagccagacagacaaatatcctgacctcacgttctgacactcttgctcctggaagtgtagcagaaaagcaggaacctgagaactgccagggcctaaatgtaatgttatatccgtttcacagttcctgcttcatgcctattctaagtcccacctcttccagaacacctaagcctaccacctttggtccttttttttttttttcttttctgaaacggagtttggctcttgttgcccaagctggagtacaatggcgcaatctcagctcactgcaacctccacctcctgggttcaagcaattctcctgcctcagccttctgagtagctgggattgcaggcatgtgccaccatgctcggctaattttttgtatttttagtagaaacggggtttcgccatgttagccagctggtctccaactcctaacctcaggtgatccacccgcctcggcctcccaaaatgcatctctggtctttaaatgccctttgctgtatattctataacatcaagtctcagatctggtttgacctcagttggcctcttaatagttttcccctatgaacattctggtctcccagtaagcctgtaagcagctgagactgggaaaccatctcttatatcccacatcgtcctatggtgcacagcgttggacacatgatgcgtgagtacagcgcatgtttagtgaacctttacatcaccacactggagcagaaaagctgtatcatgactgatgaggacccccatcagaggcaagaggcatggtggagtcttgctggaggacccactagcaaaaccactctggaaatctcggatagtaaagactctgttagtaccctgaaggccgcttacttggaaccgtatcttctaaatgctctgaaaacctatccaaaggcaattaaaatcacaaatatcattgaaaacatctaagaactacgtgtaagcacttcgggatagtcaggtaaaggcggccctctaattatgaagcattttgataattaatagaattctaagccaaagcttaaatccggatacacatcataatggttaagccaaataacacttaatcattttaccttttattattgataaagacaacacactgaagtagacagacagtaaagaaaaagtccacatctttttattgggtccaaataacctgattgtaaatacttagcctctgattttcatgtttcagaatttgtatgttaatgaccttagtagatgtggctttgtccagcctcaaaaagggttgctctccagccagggccccttttttccagttactgctcccatctcctttaagtatattcaactggtgagtgaactctttatcccgtgtgacaaatgcgtattgaggccctaacatgccccagacctcagatgtgctgctcatacatttgaggtagccctgacttgttttgggggtgtgggggtgggcttttccatcagttgtcttggttgatgtgccagtcagccaattccaaattgcactgagttttcttcattttacttttgtatattaaaaactaaatagttttttgcagcatcgtagaatagattagaaaccaagacttctgtttcacaatttataaaattggacaaatgtattgtcagtgattctgcaatgtttctgcccatttttccctcttcaggaagttgtagaggtaagatgccctattcctgctatgcttatgttgggcattataccagaaactgaagattcaaaggtgggtccccactcctagaagcccttcaaggggcagaggttcccagagaggaccataatccagtgtgaaaactgttgtactgtgtgtggatcaagtgtcatgagaacccacgtaacagcatggctgattctgctgaggaaagtcagggaatgtttcacagcagagaggacattcaggttagggcatgttgcctaagtaggagtttctcagttgaagaagattggaggtggaaggggagggaggtaaacttctcaggcagagggaaaagcaggtgcaaaggcaggaagtctgtagaagttcagattccattacccaaaacccttgagactcagatgtgtttcagaatttggattcttttggatattccacatattgtacattatgcgtaatacaatatatattgtatattataacatataatacaatatatagtatattataacatataatacaatatatagtataacatataatacaatatatattgtatattataacatataatacaatatatagtataacatataatacaatatatattgtatattataacatataatacaatatatattgtatattataacatataatactatatattgtatattataacatataatacaatatattgtatattatataacatccccagcaggttctagtcaaatacatgaatatatccaggacaaaaaggttaaatagtcatactaaatgggataaggaagactatcaatagtatcacatcaattaagtcatgttttgtggccaaatgagtttgaacaccaaacttacaaagagaacaaaaaacaacaaccaaaagaacaccttaggtttttaagccttttgaatcttggaatcttgaatacaaggactgtggctgcaggtccagcagatttctagagctaactctcattaagctgactgaggtcacatgctcatccctgacccagtggagataaatgtgctgattgccaggctgaagtcctgggcacaccctagaatggcaggatgctcagcctgccaggatcacaaagtgacctcagagtgctgtttgcaggaaaatggacacttagtaggtaaaaatcataagcgataattatatatgcatcacagatgtacccacataatattgactgtgtaatgcagcccagagcagaaccaggattcagaccatcatctctcctattccagagcccacatcagattaggctgctcacacatcagtggaaaacagtctgccccatgtaacccactgctcaattatgtgatacagacaattagaacttagcaaagtacataataagttgctaattgcatggagtacagtgcacccattcgttgaaatgatttagagaagtaaaagactttagcaggctggaaggatgtgttagaagtgatggtagagaccttatccctctgatttctgctccagggactctctttttttaagtttaattgcaaacaaacactgaacttgaggagggaaggattaacaggcagattttcctgggccctgaatgaacctctgaaaccacaggacataaattacagaggaatggaaacaagggggaagcatcgtctaatttattgacaagggaagaaaagcaagggaatcattaagggttagaggctctaagccagcttctgaggtgcttagaacaaagtatgatgatggcagacagaagtaagtctctatgacctcatgaaggacttgtttctctgctttcccagaggctcctagaattgaaaccaactaaagacctgaaagggcactccaagtgcatctggcccaacgctccctgattttagttacaggaaatccgaggcccaaggaggggaaaaatttgataaggttacagcttaaagaaaaataatgactaaaccatttcttttctttctttcttttttctttttctttttttctttttttttttttgctgaaattcggtagtgaattcaagttctcttaaggcacagttattctataacaatgcgtggtttggaggttgtgtgttttctctttacagggatttaataaaataaaaatgcaaactacttttgaaatagctataagtaaaaatacccagaagtctgtggtcagaggcaatgtccatgtatttccttaattcaggatcagcccacagatttcaacaccagtacttactgagcatctactttgtggtcaggtgttagatactctcctttaatctccaccagagccctctgtgacaggggttgtgggggtagacagataactagcttgctgaatataacttgttaaagggtggggcttggagtcctcagccatgttgagtgataccgtgctgccccgagagtttctgtgctgtagatcctggtctcttggactgttttccccataattccccatccctacctttcctaccctgcaagattgtgttggatataacttgctcactaggccttcaaaggccgggtcattttcccccctggtttataaattggcctcttatcccagggccccccctctttccccctgctccccgctccccctgccattcccacttggtcatcaccttgagagatctccagacattggcatttctttccatggggcacctccctgtcttttcaccctgagtacttaactgggattctttgaaaaacacatcagcagagagtactgtcatttttttttttccctaaacacttaaactcacataggtgtggaagtttatgccaaggaatcttggaaccagaagggagcaagggaccaaccctctctcgttagagatttggaaactgcaggacagatagagtaattggcccaacttcgcatagcaacgctaaaagttaatttatgaagtggacccctcactcagagcagtgcccggatagctgtggcattcataatgtggaactgccctcgactgtactggcggaccctataagaggcagcacgttgcaatcatggtgtttcctggaagcattttaagacccctgttcactagatcccagagaggtctttgctttagtttgggttcccccagacacagctgagccaaggacctgagtgccagtggttcctttggcaggtggttctactggtgaaaacaccagcagaggacagaggaagtgagataggaagggaagcggcctgatacaggggtgtgatcaagccagtagccactgtgggcaccagagctgaatcctgctggagacatctaggagtcagtgaagcacacacctcagaattacccagcaatgaagcaaggaagcaggcatatttgtccaccagctcctttttcattgttagttgagtaccgctataggagcattacctctttagcacttccaacttgctcctggacaagaacaaagacacccccccacacacacacacacacacatgaaagagagtcacagtgtttctagcaaactgccttcaggagctgagagaggaaggaatgtagcagtgcatgggcagaggatccacaagaggaagcgccatcagcggtcaaaaccagggaagccagaacagctggagagagaaagagagagagagtgtgtgtgtgtgtgtgtttgtaggtgtgtgtgggtgtgtgtgtctgtcttccccatgaatcccatcatgcttgcttcttgattttgtccatttggaagctcagaaccaatttacaccccacctctagctgttggataagaccttaagggaatgtcatctcttcacccaccttaccctttatttctcttatttatttcccttctgcctctctttctttgtatacttattattatcctgtttgtgcctttgaaagtccccttaagttcctttcttggtataggatgagtataaataaatacaaaagccaattacacaccaaaaagatacaaacttgggactagtcacaagcatctgccacactgctagctcttctctagttttacctcagaaatattttttttaacgaggactccctggtcttcacatgaaggccctgactgcatgggaaaaccacagaattcttgcccatacatcaaccttgcattgagaactgcaaataaagcaaaatgcatgttttcttcaaagtggccacagagacagatgcccatcatccccacaatgctacaaaataggatgcagcacatgggtgacatgatgagaggtccttgaaggccaagtaggatcccgggattctattttgctgaatcaggattcaggatcccatgattctgttttgctgaatcaggattcaggacctttttcaaaacaagtaaaacagaaaaataaagtgcaagtaccaacagaagcagcctccagaacttttaattgttatactcttacctctttttctctttttttttttttgttttttgtttttctttttttaattatactttaagttctagggtacatgtgcacaacgtgctagtttgtcacatatgtatacatgtgccatgttggtgcgctgcacccattaactcgtcatttacattagatatatctcctcatgctatccctcccccttcccccgaccccacaacaggtcccggtgtgtgatgttccccttcctgtgtccaagtgttctcattgttcagttcccacctatgagtgagaacacgcagtgtttggttttttgtccttgctatagtttgctgatctttctctcttttttaagaacaatctttaaaatgtttcctcctatgcatgatttttgttaacttttttactgcttgtctatagagtatatgacaaattttctttaatcagcatgtattactttaaaatggggagaaaatgaaaaagtgttgtctcatctgaatatgtttttaccataacatcccccaaaatgccttcttttctaaaaatagatgttttgctagaagcatccagggtaaaatgtggcctgccactcagaaatctaaagttttagttgttttctttgctggtcaggagccctgaagcagcggagattctgccctctgatattcatggatgtgagtgctgacccacacggaggctttctttgctatttgatttcatgtttcaagggaaatgttaagtcagatgtcactgttaaagggaaagagggaggaaaagaagaaagagagagagagagggagggaggacaggagaaagaaaccatataaatctagagtccagtcttgtttgtttctttatttggcccagtgatcaataatgtattgactaaacatctttcaaaagttatttatttataatgccttcattctaaaaagaatttaaaataatgtttacaaatgtagtgaatagaatttacaagaaaacaaataagggaggaaaatggagcaaagaggaaactgggtagaaaaaataggacatgagtaagactggtgtctaaactccgtgcctttacatctaactagagatgtgtcaaaaattttactgtgagctccctagcagccaaagcaaagaaagaaacaattgaatgtgtaactcataggtaaaaataagtgaaaggctgggtgcggtagcttaggcctgtaatccctgcactttgggagaccaagtcgggcagatcacttgaggtcaggagttgaagactagcctgaccaacatggtgaaaccctatctctactaaaaatacaaaagttagctgaacgtggtggtgtgtgcctgtaattctagctactcaggaggctgaggcaggagaatcacttgaacccaggaggcagaggttgcagtgagctgtgatcgcgccactgcattccagcctgggcgacaaagttagactctatttcaaaaaaataaaataaaataagctgatttatttatttattgagttaagtaagttggggcaataaaataaagcggataaaatatattagccctttgactcaagaagtcaataccactttttatgagaacaattaataacacctaacatcagtgaacacttcttatatgccaagcactaacctaaccaatgtaattatgacataagaacaccatgcatcaggtaaagccagttatattttaaaagtagaatttggggtttacaaatggctttctcgtttgtgttgttacttaattgctcacaacaaccctatgagagatattggtcaggaaaatatttttatatgaggaaagtaagatcacatttctaatcattgttgcacccggaatataaatccagattactcagatatactttttttttctttttttttttgagatggagtcttgttatctcacccaggctaaagtacagtggcgccatctaggctcactgcaacctctgcctcctgggttcaagcgattctcctgcctcagcctcccaagtagttgggactccaggtgcacaccaccacgcctggctaactttttgtatttttagtagagacggagtttcaccatcagatacacattttacactacttcataatctgggagcaaaaccctggtgatgggaatatggacatttggctttaggatcttaagctgagtttgttcaggtgagttgtctactcctgggcctgccattaagtggctgtgtggtgttgggcgagtccttcttctccctagagtggcagtgtcttcaactggaaaataagaaggttgatgacttgtctgggaagattcattccagctgtgacagcctgttcatctctgggtgtctgtggctccaggcagtttcccagactacactccagggtgttcccagtcattttcacattagcagttgctctgtggtacagacgtggctgcgcctctgtggatcattgaaccttcaccattgccccagcctgcttggggctagggtgtgtgggctgtgaattaaaggctgtgagacgtcagaactccctatgagcctgaggtgtcctatggggcatttccaccgtgtcggcggaacatgtttcattgttccttccttgatactttgtcttccatagattttttgaagggattcaaagtggaaagcaccagaagttggaactagacctgctgaagaactcacttttttttttttccttttaaaacttctcttgagcccaaaaatcacatggacacatcttgaattcttacaagttagccgggtctcagtgaaagggcttccctgaggggtagaatgccgcatgctcgtttcctatgcctagataaataaaccctggcccaggctttaggctccaggtttgtttctggcatccctttgcctgaaagtttctgtgttgaataaaacagaaatgtttagcaaatcccaagaaattccttatttaatggaaaaaagagatccctgggcttatatttcaaaatgtgatttccatgttcccactgcattaaggcaaggtcgcctcaccaaatccccagatgtctggtatgcttttcgaaaaatgcctgtatttagcccctagaacacattttgagtacctattgtggacaggattctcctctgagccctgcaggagatagagcagccaaatgagatggaaacccttccttcaaatttagttgtaatggttgcattagaatctataggaagtctcacctttacctacagacaagctttattcccccacgctgatcttttaaactgtacaatattgcatctctgtgtggccatctgtcctccttcatgacaatgggagattcagctgctggggttggccacaaacagcttatcttattagctaacctaccatgtatgagctgccttggcaatatccctattaattatattttctttcttcagcatcttagaagagtggggtttttcatttgcttcatgtctctgccaatcctaacctctctctcctaaaatgtttatttatcttttgttataaaagtagttgatgtttattgttgacagaaagagagagagaaacagggatggatattgcagagaaaaaattttaaaaagctatttataataaaataaaatcctaccacaacaagcttattgttgtttatattttggatttacaaaatctttagctatttatcctcaacccttgccaattatgtgaatttccagttgggtgagagtagctatattaaatagtgagcagttttcctgtatcattaaatagtcttcaaaaccttgattgttcatagctgaataacatttaatactatgggtgaagcaattattttaattgtttcctttgtgctgggattgtagattgtttctatctttttacttcaaactcacctgtagtagtggctgttgcaaggtagccacttacacagtataccactttcttccctgcatgctgggaactgcactgcatgctggaaagcacagcctggcactgggctggctctagggtaaagaaagaagagacactggcttgccctcagggagaggggtggggagctctggcgctgggcatgtatcatgtctactaatgtgatacttaatattaggagccacccccttgaagacagcggagtccaaaagggcttgctgagtcatcaaatactaagttggttcagcataatcttaggattctgtgtgttttattttccaagtcggaaagtagggttaggggtggggagaacactctccaagagaagctgactcaagctacttctcaaagaacaaagtgacacacaggaaggaggttggttgggaggggaaaggagaggtcattccaggaaaggcaaacaatgtcaagaaagggagcctggcagggttaggtatgtgccaggtctttgttctggcctgagtttaagatacctgggaaggcatgccaggagctgttcctggagaagtctgtagagggcataccctgagaggcctttgatgccccaccaaggaggacgacttcatcccaaagacttcgtgaggctgctaggggttacacatagaggcctgagcttggcagacatgcactttgggaaatacactgtggcatctgcaggagggacaacagacttagggtttctggggagagttggtgggtgaggaatccgagcctcctaggtacaggaatcatgacttgtttactgctcacccagggccttgcacagtgcctgacatgcagtaggtgcccagtatttattaaatctgggaaaagttgttaaacgaatccaggcagggaatgccaagggtggtggcagtgagaatagaagatagggatcctcttagaaagacatttaggagggacgtgggtgaaaatttttaatctgaaatccaaggaccgaagaaacttcattttttagtgaagcgcaaaaactagaaggtagctttgaaaaggcgtttgacttcaggaaccaattggccaaaggaatgtttctagacctttcaaaactttaatctgtgctttgtgaattacacagtttggttctattcaatagttccctttttccctcaaatgccacctgtgaaataagttaaacaccatactgttttaatgtaaaaatatttcctcaaatccactgtataaattaattactctttggggaataggataatctaatttcccttctacaatgtgctccattcatatgctctccattgctgtagaggtaggttatgaatcaactgtttctgaaggattatgagctataataaatgtcaatatgagctctgattgatttcctgcagcctcactagttgtgacttcatttagtaacttaatactaattgtgtcgctttgattactttgattttagctgtttccccagcacctactggagtgtctaggacaagcaaggattctaatgaatgtctgttgaatgaagggcttttaatctttttaaaatgttccatagaggattttagagaagtcggagtgaatgcctgcagttcagatgggtattgactgaagaggcgaaaccataatttcaattcttgagaaagtagcgcagaacttctctagctcactactgtatcgcagtacctcagtgcacagtagacagtcagtgaatatttgctgactgaccctgtattgtagtgtctgatggtgagccacagcccttagttcaagtatatgccttagagagtaatgcatcccttcatgtatgcattcaacatttattaagcccctattgtgtgtcaatgcaatggcaaacatttatgataggctcaagttttgaaccttgcaacaaccctggtagatattattgtcatccccttttgctgacaagcaaaatgaggcttggaaacactaaactatttttcatataattaaaaggtatgctgactccctcatctagatcctcatgatacctaacactaagttttggaaacactaaaccaagatcatataattaaaaaggtaccatccatccaattaaaaaggatccatcctcacctggatcctcatggtaccaataactgggtcctgaatctcctttcactaactaagtcagcagcgatggctatgaaggtgggcattaggatgtcaaagggactgtcacacataggtttgcatctctggcatcatgctatgtgaccctgagcagtccgtttgtctgtctgagcctcagtttgtagtgcccaggttagaggtgatacaagacctctaaacatgaggtcttatatctcatacatgaccgtgatcatctcttcacaggaggagcttcaaagtcacatttccacaggaattgatatggaaaggcatgaacaggtatagccatttttgtaatctaccatagcgattgcctgaaactgttacaatctagtccatttctctagatatcctggaatatgttctgaccaagcaggactggcagaagctgcatacctggaccacagcattatagtcttctgtggaattacctttatgcttggggctttagcgatgcatcagccgtatatagaggaagttataggaaaccgaactcatgcatctcactatcgtatttactaccagcttgttgctgagggcattgttcattttactgcaccatgggagagattactctcttgtctcagcactaggcaaacctagacttctctaaagctgggcttgtttggttttttcaattttatggatttgtaacttaggaagccaatggatttctctcttcaagttgtctgctggaaagcttaaggctgaatatgtgatctaccaccagcaaatacaaagaccatgtgacatgtattttggcactgatttcacttttagcttcatattattattcctttaaacagatctcatctgtacatactttaagttttattttgttttagtgatgagcaaaaactagaaggtagctttgaattgcatactttgtaagttgcctaaaatcctgtttgaatacagtaggtgataaataaaatcactaaaatgaatgaacaagaagagtaccttcatatacccagaaatgcactggaaatcgggacattttgtttcttcgtctttaataagttgtgtttgaagtcctacattgagccaaaattcatacctggaaactgaattctagaaagattattttggaaagcctgtagttacgtgtattaccactagatgaccttccctcattattgtctctaaagtggagctgctagttatatggactttccagaggactgtaggaaatttatgaataatccctctaaagcaacaacgacaacaacaacaaaaaagtctactttatatggtgttgagtgtacaaatatttggcaaaggaatgaaaaaagttagaaagttgtctgtctgtgggctaggctctgcctgcaagatacttacaatctaggtcagaggttcctaaatccttctcaatgccgtttgcactggccctgaggaaagtgtgaaaatgaagactattgtagagtcttacatgaagctaaatttgttcatttatatcacttctcttttattatgagattatgtcctctgcagttttttggtattaaaatgtcttttatgaaaggatagtaagagttagatagtagtcttttttgtggaaaaaaaaaaaaattgttctcacttgacaataaaaagtggacaaatccatggagccctcaaaattctttttggaaattttgttctataaaatccaatattctgaaaacctgtggttgaataagagaaaaatatttagtataatctttctcaatacatttgcatgcatcaggaccttaacagaaaatactacctgttagcatttgcagttgagctcctattaaaaaccatgtttgtttgtttgtttttaaagatgtttaggaaaacagtttaaggaacattctccttcctcccctctcactgggaattctgaatctactctttgagcaagtcaaaatacttggacctcagctcaggcccctctacacgtcacctccagaaagctacattctgctactatgttcttagcttttatgaaagatgaaacagccaattaaaaatctacttctgccttcattttgttttttgttaggacagtcatgtacatagtacatactatgaaattatgtcagtttgattgacaaccatttgattttactaaaactctgcctcctgaattcaagtgattctcctgcctcagtgttaaggacactttctcttatatcacacagtagacgttaaggaaattttagtatcctttctaatttcctttgaatttatcttttctccccctttcagataaaaagataacatgttaccttttttgccttggctaccagtggtctcaaagtcaggtgttgtactcagccagaacagctttgttatacccttaagcttgatatcttttctgtttcctggtttcttccatttttatcaaccttataatgtcttttattcagagctcccaaaagcctatattggagtgatatacaattactttttaaataaatagaatgttttatataataaatggtatttttggaaagtactggattatgcagtatgaactgtaaatgtctccagagtatattacatgattgtcctaacaaaaaaaaaaaaaacctttagtactttattaagtatttctcatattcaaaattatctcacctgtgtgctgaactagactgtaattccttttgtggaaggaaattttgttttgtatgttgttttaaatctcttgcagtttctctcgatcagtgccaggacatcagacatgctcaatgaatacttgctgattgactaatccactgatctgtgtgttctgggggagttagaaaagctttcctagaggagatgcaaagagatggccagaagacaggctgtttgccactctaatccttggcttctcacatgttaaacatgatggctaaggtctctaactttctggggcttgacagttgtaaaatacgaggaggataggagactgtgagggggtgaaagccagttttcagattcacagaggctggaaataaatttggtatatggggaagctttggagatggagaaatgctttcgaaactgtgaagtacatactatgaaattatgtctctttggtttacaaccatttggcgttactaaaactttcacttgatgccctaattcagctctaaggggtctgtcttggcatttatgaaagccattgtggactggtgcaacctttatttatttattttattttattttattttatttttgagacggagtcttgccctgttgcccaggctggagtgcagtggcatgatctcggctcactgcaacctccacctcctgagttcacgttattcttctgcctcagcctcccgagtagctgggattactggcgcccaccatgcctggctaatttttcgtgtgcggttttagtagaggtgggatttcaccatgttggccaggctgggctcaaactcctgtcctcagatgatccgatggagggaggctgctactctctaccatttcctgtgtgcctccactgtggcctcaaccctggcagttaaagccactgctcccttcccctacctggcatgtgtgagcccttctcactggattttatacccttgtgtctgtgtacattatcgatctatatagtatatatatacattatatctatctatatagtatatatattcattatatatataatgaatatatatacacacaattgataaattgaatatatatataaactctgcactggtgcatcttgtaagcggcagtgtagactccaggtggttatcttggcagtggggtagctagcaccaacatctggctgagtgcccttcttaacaggtgactcgaggtttgctaatttatagcaaggatgatgctcattatgatgtcaacctgtttgataagtgtcatgtcatttggattctgccattgatttcttttgactttatttttttaatggttaaattatataaactttgtataatgtaatccataaacatgctttgtgactttgtgactttcttttttggtggtgacaggatttcgccatgttgcccaggctggtctcaaactcctgagctcaggcaatccacctgcctcagcctcccaaagtgctaggattataggcgtaagccaccacgcccagcctatagtatactcttaagtgtactcttcttaagtggcctacgacgagcaggtaaacagccattcgatagactaaataataaatagaaaatacttgtttaggttatattgtgataatatatgatagtaaataatgaacactgttttaatgatatttggtgttatctttgcatacattaatttgacttgggggactctggactgcattaactttttttttttttttttgagacggagtcttgctgtgtcgcccaggctggagtgtagtggcacaatctcggctcactgcaagctctgcctcccgggttcaagtgattctcctgcctcagcctcccgagtagctgggactacaggcaccagctatcacacccggctaattttttgtatttttagtagagatggggtttctacgtgttagccaggatagtctcgatctcctgacctcgtgatccacccacctcagcctcccaaagtgctgggattacaggcgtgagtgcattaactttttaatcaaactagcagtaattatgttttcagtttaagataagttgcctttataaatttggggataaattggatttaggtaaggcagtgttattactttacttcttttgtattctccataacagctggctcttcatggttgtacagtagctattgttaacttgcttgaggccagctgtgtgtgagcattaccgagagccagaatgtcctcctgagaaggggctcctcacgcctgttctcatgatcatctgcgtagcagaagcctatggagttccgatgagaaagggaactggaaatccctttgagtaaacaagtccccagaagagggagagcataggtgtgaaaaataataattctaccatctaaattccatttctcagccttagttaacacaggtcagaagatctgtcatttgattaaagtcacttccctgggactgagaaaagattgctactgtactcttgaagggtgattctactccactctgtagtaaatgcctccacatggtagatcccctcaaattgggtcatgtatctctcctctgccctcaacccttgggttttatttcccatttatagctttcaaaatattggagacaccatggtttggaaggtaaaacaatagcaatgagagacacctgtttataagtagagcaattaaaaacctagctggtgaccaaacctgcccaactctatgtatattagttttctatcactatataacaaattaccacaaatttagtggcttaaaacacataaacggtggggttttttttttgaggagggtgatgctcagcatcgaatgacgaatttgtcattcacctagcatttattaagcaaccacaggatgcaaattacactgtgactaattggagatattaaaaaatcacataataatatcctgctcttaagaaatttgtgctttcccaagagagagttttcaaaaaagaatacatgtaatttgtacacagcaggcagtaagaagtatagatgtcatgctaggatagttccaaggagaggaaaattatttcagggaaatgggcatggtgacctgcgagctggacttgaaacgctagagagatatggagagatgtaggctttgtctagactataaagtaagaagtgacattgggaaagaagttaaatccttaaatggcagactctaaggcggttaggctccagagtctaagcttttctttttccagatttattgacatataattgacaaatgataattgtatatatttaaggtatcaaatgtgatgttttgatatatatatacattgtaaaatgattaccacaattcagctaattaacatatccatcacctcacatctttgtgtgggtgtgtgtggtgagaaaatgtaagatctactcaatttcaagcatacaatacagtatcattaactatagtcaccatgttgtacattagatcttcagaaattatttatcttgtgtaactgaaactttgtaccctttgactgacacctccacatctctccaacatgaagttccaccaccaaggccctggtaaccaccattctactctctgctttcatgaattcaactttttttacattccatctataagtgagatcatgcagtatttgtctttgtgtatctgactcatttcacttagcataatgtactccaggttcattcatgttattgcaaatggcaggattttcttcttttttaaagctgaataatattccattatatacatatatatgtgtgtgtgtatatatctacttatatacacatatgtgtgtgttatatatatacacacacacacaccccatattctctttatccattcatccatcaatggacacttaagttatttccatatcttggctattgtgaataatgctgaaatgaacatgggagtgcagatgactcttcaaggtaatgatttcatttcctttggatatatactcagaagagggatagctggattataaggtcattctatttttaatgctatgaagagcctgtatactgttttccttaatgaccataccagtttgcatttccatcaacaatgtacaaaggtttccttttccccacattctcaccaacacttaatcttttgtcttttggcagtagttattctaacaagtgtgaggtgatgttggattctggttttgatttacatttccttggtgattagtgatattgagcatcttttaatgtacctgttggtcatttgtatgccttactttgagaaatgtctattctgttatttgatttttttgctactgagtcaagccccttatatattttggatattatattccttatcaggatatatgttttgcaaatattagcttctattccataggttgcctttccattttgttgattgtttcatttgctgtgcagaagatttttagtctgatgcaatctcacttgtctgtttttgcttttgttgcctgtgcaacaaaaaaatattattgcctggaccagtgtcaaaaaacttttttcctcttttctcctggtagttttacagtttcagatcttacacaattcagtctttaatccatttgcattgatttttgtgtagagataagggtttgattccactcttctgcatgtggacatccagttttcccagcaccatctgagagactattctttctccattgtgtgttcttggcaccctggttgaagatcatcagttgactgtaaacgtgtgggtttatttctgggctattccgttccattggtctataagtctgtttcttatgttcataccatactgttttgattactgtagcattataatattttgaaaccagaaagtgtgatactttcagctttgttcttgctcaggattgctttggctatacaggattttttgtggttttatttgaattttaggattgtttttcagtttctgtgaaaaatgcctttgtaattttaataaggattgcattgactctgtagatcacttttggtagtatggacatctttaattcttccaatccatgaatgtagatctttctatttatttgtcttcttcactgtctttcttcaatgttttatagttttcagtgtacagatcttttacctccttagttaagtttattcctaagtatttcatttttgtaaatgagattgttttcttcatttctttttggatagttcattgttaatgtatagaagtgcaactggtttttgtatgctgatgttgtatcctgcaactttattgaatttgtttattagttttaacaggtttttttgttagggtctaggattttctatgtataagatcatgtcatctgcaaacagagacagtttgatttttttcctttcgaatttggatgccttttatttctttttcttgcttacttgctccagctagtagttcagtattatgttgaatagaagtggcaagagtggacatccttgtcttgttcttgatcttagagaaaaagctttcaatttgtcactattgagtatggctttagctgtgggcttgccatatatagccatattatgttgcggtatatttcttctatacctgatttgttagtttttatcatgaaggatgttgaattttgtcaaatgcttttttctacatcagttgagaggattatataactaactttagtccttcattctgttaatgtggtatatcacgtcttgatttgcacatgtcaaaccttccttgcatcccaaggataagtaccacttgattgtagtacatgttccttttgatgtggttttgaatttagtatactagtattttgttgaggatttttgcatctgtatctatcaagaatatcgatgctggccttataaaaagagtttggaaatgctctctccctttcagtttttttgaagggtctgggaaactttggcattaatccttctttaaaggtttggtagaattcactggtgaagccatccaatcttgacttctcattgttgagaggaattactgattctatctctttacttatcattggtctgttcagatttgctatttctttatgatttagtcttagtaggtggtatatgtttcagaatttatccttccaagttattcacctttttggcatataattatttatagtagtctcttaggatcctttttgtttctgtcatatcagttataatctctccgctttcacttctcattgtttgagcctttgactcttttcttatagtctagctaaaggtttgtcaattttgtttgtcttttcagaaacccaactcttagtttcattgatctttctgttgtttttctagttttatttcatttatttctgctataatctttattactttcttccttctgtgaattttgggctttgttttttttttcctagttctttgaggagctaaagtttctaaagttacgttgtttatttgagatccttgttttttcacagtcactataaactttcctcttagaactgcttttgctgcgtctcttataagttttgatatgttgtgtttccatttttgtttgtattaatatgtatttttattttccctttcgatttcttccttgatggttgttcaagagtggatttagaggtgcattgtttaatttccacatatttgtgaatttttcaattttcttctgcaatttctagtttcatactattttgatcagaaagatacttgatataattacactcttcttaaatttgttaagacttgttttgggcataatatatgttctatcctggaaaagattctatgtgctcttgagaagaacatgcattctgctgctgttggtagaatgttctgcacatgtctgttgggtccatttggtctatgtgttgttcaagtccactgttccttatggattttctgtctggatgatctgtttactgttagttagactggggtactaaaggcccctattattattgtaatgctgtctatttttaccttcagttctgtcaatattgggtgctccaatgttgggtgtgtatgtatttataattattatattctcttgatgattctcttgatgaattgattcctttatcatcatataatgattttctttgtctcttttgactgttcctgacttaaagtctattttaagtatagtcacctctactcttttttggttaccattcacgtggattttttttttcactttctttttttttttttttttttttttgagacaatgtctcactttgtcacccaggctgaagtgtagtggcatgatctcggctcactgcagcctccacttgaatcagttcaagtgattctcctgcctcagcctcctaagtagctgggattacaggcgtctaccaccatgcccagctaatttttgtatttttagtagagacagggttttgccacattggccaggctggtctcaaactcctgacctcagattatctgcccaccttggcctcccaaagtgctggaattatagacatgagccaccatgcccagccttgacttttttcactttcaaccagtgtttatccttaaagctaaaatgaatctctgataggcaatgtatagttgatcttgttttttaatccattcagccattcaatgtcttttgattagataatttaatctatttacttttaaaataattattgatagttaagaacttactgttaattgtttctgttttttagttccttttttcctttcttcctctctagatgtcctcatttgcaatttgacaattttttgaggtagtaggctttgattcctttctcttcgtactttgtgtgtctactagtttttatcttcatgatttccatgaggcttacataaaacatcttatatctataatagtctattttaagccgataacaagctttgattgaatttaaaaatctacatttttaacttctgttttccatattttatgttattgatattacaatttataacttttatgttgtatctctattaacaaattattgtagccatagttatttttactattttgtcttttcactttataccagaattaaaagtaatttatatgccaccattacaatattgggttattctgatttttgactatattcttaccattgttagtgagttttatactttaaaagttttcatattgctaattcgtgtctttttgtttcaacttggagaactctgtttggtatttcttgtaaggaagacctaattataatgaacttttgtttgggaaaatctctttgtcattgtaatttctgaaggacaattttagcagatatagtattcttggttgacagggttggttgtttgttcctttcggcactctgaatatatcctcactgtctcctcacctgcaaggtttctgccaagaaatccacttataatctcatggagtttcctttgtctatgaagagtcacttttctcttgttgcattgaaaattctctctttgtatttgacttttgacaatttggttataatgtgtctcagtgaagatctcttaaggttcagtctgttcggggttacttgggcatcatggacctggatgctgaatatccttcccagaattgtaaagtttcttgtcattatttctctaaacaagttttctgcctctttctctttctctgctccttctttgactctcataatgcatatattggttcacttgatggtgtcccataagtcctgtaggctttctttacacttgtttattctttttgtgtgtgtgtgtgcctcttaactagataatttcaaatgacttgtatctgagcttaccaattctttcttctgcgtgattgagtctgttgttgaagcactctattgatttttttcagttcagtcgttgtattacttagtgccaggattttttatagtttgtatttctttatcaaacttctaattttatgcatgtattatttttctgatttcatttagttatctaattcttttgtagctcattaactttaagatgattattttgaattctttgtcaagcagttcatggacctccatttctttagggttggttactgatgttctattagtttattttggcggtgtcatttttgcctgattcttcataattcatgtagccttggattgaaggggcagatacctcttctagtcttttccatctggttctggcagataaagactttctcttggctgatgggactatctctgggatcatattctactatcttgctgatgtcacacccctcaatataaatgttttatgtcacaatttctataggtcagaagtctgggcacagcatgactaggttttctgttcacggtctcactgggctgaaatcaaggcatttaccagggcaccaccctcatctagagcttggaatatttttctaagctcactggttgttgccagaattcatttccttgcatctggaagactgaagtagccatttccttgttggccctcagctgagggatgctttgagagtcctaaaggccacccacattccttgtcacatagctccctttgtcttcaatcagaaacagcatgctaaatccttctcatacttcaaacctgtgaccagaaagagaaaactatctgcttttaatcatgtgattaggtcaggccactctgataatttttctgaaggtcaactgtgccatttaacataacctaattgtgggagcaaactccaacacattcacagtcgtgggattatccagggtatgcagtacagcagaagcaggaaatctggggatcatcttagaattctgcctaccacactattctgtgtttccttcatgaagctgttgacattcgttaaaggaagctgcttatcacaaccaacaagcattatgcctagtcagtgctaggccctatggaagatataaaatgcacataggaataagcccatctctgaccctttacagttttcaaagcacttttatagctgtgatctcattttctcttttaaaaaccaaaaaacatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactcggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccgtaaaaaatgatgagttcatgtcctttgtagggacatggatgaaattggaaaccatcattctcagtaaactatcgcaagaacaaaaaaccaaacaccgcatattctcactcataggtgggaattgaacaatgagattacatggacacaggaaggggaatatcacactctggggactgtggtggggtcgggggagaggggagggatagcattgggagatatacctaaggctagatgacgagttagtgggtgcagcgcaccagcatggcacatgtatacatatgtaactaacctgcacaatgtgcacatgtaccctaaaacttagagtataataaaaaaaaaaaattaaaaaaaaaaaagaaaaaaaaaaaagaaaaaccaaaaaacagttttaccatgttttcattttataggtaaagaaaatggcagatagagaggttaaaacattaacttgaggtaacacacccagtggcttggaagctgggacttttgactcaagaatgagatcctctacctctaaaaccagtactctccctgtggcatagtttcattgtcaagaatctcattgtcaagaatcttgtcatggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaagaatcttgtcattgggaaaagtgagacacagctgaagattaggaggaaatatcatactggtgcttttatttattttttttaatttttaattttttttaatttatttatttatttttctgagacagggtctcactcctgtcacccagaatggagtacagtgatgcagtctctgcttaccacagcctcgacctcctaagctcaggtgatcctcctgcctcagcctccctagtagctggaactacaggcatgtgccaccacacccggctaatttttttgtattttttgtatttttagtagacatgggtttcaccacgttacccaggctggtctcgaattcctgggctcaaacaatccacccaccttggccttccaaagtgctaggattataggcgtgagccaccacacctggccagtgatgcttttaaatgaggcttatgttcaagggcagtatggggctggggtagcttggaatacatgtgggggagataggtatcagttatgcagagtgggagaaaaagagtgttgcagtcagggggcacagtttgagcaaagacaggaacaagcaatgtgtgttgtgggagcatggggagatctgtcaaagggttaatgactgagtgttgacaatttggtcagggaggtgggtgagtcatgggaagccttgtgagagagacccaggaatttgctgtgggatgttagacattagggaccttttgtgctttctttttttgctggagagtgatttaaaatagcagttttacaatggagagttggagattcacatagtcatgcattcactcagcaatttcaggtctgaatatatatccgaggttcattaatgccttatacagtgaatttagtggattttgaccagcatgtaaattatagaattaaatggacttgaatatattaaaggacataggatataagagtaataagtcctatttcataaaatagttccaatttgtgtgtgtttgtgtgtgtgcatacatattttgtgttttgtgtagtctggtgtgatataaattatttatttatttatttttttatttattggagacagagtctcactgtcattcaggctggagtgcaggagcacaataatggctcactgcatccttgccctcctgggttcaagggatcctcccacttcagccttccaagtagctggaaacacagtcatgcatcaccatgcccagctaactttttaactttttttggtagagatggggccccatgtgtcaccctgttgggtcatgatctcctggcctcaagcaattctccggcctcagcctcccaaagtgctgatattacaggcatgagccactacacttggcctaaaatgtatttcttactgttggtttcagtaaaaagtttgaaaaatactacccagaaaatcccttgtacatgtgtgcacagagacgagtacaataatgttgctagcagcactgtttattatcaccaataattggaaacattctcaatctccatccccacgagaatagataaataagttgtggctatgcatgtaatgaagtacagagtaacactttaaaaacaggaaaactagagccacatgtgtcatcatggacacaaataagaaatcaaatgtgaaagaaagatggtttctgaattataaatgtactatatcatttacagaaactttttaaaaatgtaaaacaataccatcaatcatttctagatctgtgcatatcagtaggaatataaatatgcatggaaattatgaatgccaaattgaagatagtggttacggctgatgaaggagagaggggaatggagttgagggaaggacgttcagtcatatctgttgggttaagacaaatctgggtgatggaaacccaagtgtttgtggtgtcattccctatctttgtctgaagacttgaaatattccgtaatacgtttgttcacagcagaatttcagaatggcatgagccagtgctggacgaagactgatttggcagcttgtaataatgtagttttgaggccgtgtggacctggactaggttgataggaataggccattctcattatgcagccataaaaaggaacatgatcatgtcctttgcaggaacacggatggagctggaagccattatcctcagcaaactaacgcaggaacagaaaaccaaatactgcatgttctcacttataagtgggacctgaatgatgagaacacatggacacatggtggggaacaactggggcctgtcagaacgggtgggtggggggagggagagcatcaggaagaatagctaatggatgctgggcttaatacctgggtgatgggatgatctgtgcagcaaaccaccatggaacatgtttacctatgtaacaaacatgcacatcctgcacatgcaccctgaacttaagagctgaagaagggacaggcacgatggctcacgcctgtaatcccagcactttgggaggccaaggcaggcggatcatgaggttaggagatcaagaccatcctggctaacacggtgaaaccctgtctctactaaaaatacaaaaaaaaattagccgggcatggtcgtgggcacctgtagtcccagctactcaggaggctgaggcaggagaatggcttgaacccgggaggcagagcttgcagtgagccaagatcacgccactgcattccagcctgggcgacagagcaagactccatctcaaaaaaaaaaaaaaaaaaaaaaaaaaaaaaaagttgaagaaaaaaaagaatagtccgttctcatatgacagtatgtatgataacagtaatgacaatatcttgtgttgtgaaagggcttttcaaaatagaaaagcacttctatagacttcctcttacctattgtcacaaaataggcaaggcaattgtttattatgaacctcagaaagctggaatttggagaaagtcagtgactgaaggtaagacagtagtgtgtggtggagttcggaattgcaattggctgtccatggcttttctagcctttcaaggctgccctgttgtgcctacctttggtctaagctcaagtgtcattctttacatctccttctgttttctgtttatgcatgtcacaaacatataactatgtgataagattttgatcgctcagacagcttcacttctcacacagcaagagcattgctataccgatcctcttggctgactcccatctgcaaggtagaggagcagatcatcccctgggcttccctgtcacacatgtgacatgctccatgtgtggcagatgacactgaaagggagagttcaaggacaaacacctggtgaattcatgctggtgaagctccaggagatgtcagagggcagctgttgggagtatgaggcccagtgtaaccttctgcaagaatgtttgcaaccagcctatttgtgggagagatgttcagactgcggccagatttttttttagaaaaaaaaaaaatcaataaatccagatatgttccatataccaaaaactgagaaacaaaaaagtgggtatataacaaaaaggcagcaggtaaataggtaaatgggaatggtattgttcagaagtggtttcattacagaaataaaggaagaaaagaagaaaacaaatgtttgtgggcctgatgggtgacaggcaccatgtcgtgttttcatgaacattatttcgtgtaattttcccatccctatgaggcagatgttaatgcccctcattttaaagacgaggaaaagagagctgggggattagcttgttggcccaaggtcactggctagcatgtgatgtagccaggatttgagctacggtttttctccatagcttgcaatgtttcctccatatcacacagcagtaacattgaaagagaaaagtacacacatttctaagccaacatgtggccaccatgggaagaagcagagaggaagtttggatcttttggcagggaaaccatttgaggttcttgacagttgttgaggtgaatgccctgttcccccatgttccaccagcagtgaagcccatgatgggcaggagctgcaggacgcagtggcagggagaaggctgttggcagcccccagagccatctgagcgtgtgcacagccacatggccctgccgccccaggaattgagctgttacttgtctgtagaggtgctaggagaagctgtttgcccggcatgacaagttggaattcagaacacattttcccacagaaaccatgccctcctgggtagttgggttctggtctccagaaaaacaacagaattgtgtcactgttctatacgtggtgatcgggttcccagacctgtctataaaagtgaatacactgtgggctggattcacttttatagataggtctgggaacccaatcaccatttacagaatgcattttgtgggaaaacacgttcatagttcagctttcaaatgtttggaacgtagcctgcctctaggttgagaacagcatgcattagaatattgagcatcgaggtgttacaagtcctgagtttcagtgctgactgagaggaggggtgaggagtaacatttagcaagcagccacacggaccccatgctgagctgactgtcctgcctgccctctctcatcgcgttccagcttagttctgtgaggtcagcaggagcatctttgttttaatgcagagcagttggaatgttggagagattcattaacttttccaagggtatgcacctagcgaaaatagagatttgaacctcaggttctttccagagagggtcagagccaaatctaaatcaagtggagaagtgagcagaggaagtgagcagaggtttctatcctgtccccagccttatctctttgtccattgtgataaaaagagcctgtaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatagcgtgaacccgggaggcggagcttgcagtgagccgagatcccgccactgcactccagcctgggcgacagagagagactccgtctcaaaaaaaaaaaaaaaaaaaaaaaaaaaaaaaaaaaaaaaaaaaaaaaaaaacctgtaagaaaccctcatgggtgaccttttaaaagcaccctaactcgctggagacagtgtgacaaggcaggatgacagtgccctcctacctgttcctgctcttctgtcctcggtgtttggatgcaaattcttactatcagctggggaatggtggctcacacctgtaatcccagcactttgggaggccgaggtgggtggattacaagagcccaggagtttgagaccaaccaacctgggcaacatggcaaaaccctgtctctatagaaaaaaaatgcaaaaattagccaggcatggtggcatgtgcctgtagtcccagctacttgggaggctgaggtgggaagattgcttgagcctgggaggtcgagactgcagtgagccatgattgcgccactgcactccagcctggacaacaacacaagatcctgacaccccttcccacccccccggcaaaaaaaaaatcttactacccaaattagtgactgtttgaaatcactaagaatgggggctgatgagaaagagggaagaggggaaaggtgcccaggaacaggagggacttgagagggtggtgaggtggggcagctggacatgagctgcacaatggtgctgaatgcagctcagcatgggggttgccttttcctgcccggtccctctctctgccccttctgcctcacagcctagggatccactggactcttatttcctttcactccagtctgttcccaagcctggatgaatccttttttttttttttcctgagataaagtgtcactgttgcccaagctggagtgcaatggcacgatctcagttcactgcaacctccaactcccgggttcaaactattctcctgcctcagcttccccagtagctgagattacaggcatttgccaccacgactggctaatttttgtatttttagtagagacagggtttcaccatgttggctgggctgttcttgaactcctgacctcatgatccacccacctcggcctcccctcttagtagctgggatttctgccctctgtgagccagcctctgcctgagctccagagtatccagcccgacccaggtgtgcccaaatgatccaggcttccaaaatcaaagaggctccccacattgccttaggtggagaccttaggcctcttccctggggtctcagctgcttcccaggcttcagcagcagacatgggaaagctgtgctccagatcgctggtgctcagacctccatgtatcgaacaagcattaacccatttcctaccccatatcagtattgtgtgatgtgcatgaggggaaataagatacagtcttggtctggaggacttcctagtcaagaaagagagatagaagttaacaaagtatattttatgcatgagggatatacaaggagctcgggagcggaaataagtgagcagctgagtctcctttgggagggagggattggggaaggcttctctgaagaggtgacatctgagctaggtgtcaaagaagaaggaagcatttaccagctatctagggggtcagtcaatcccagtggtgggaactaagtggtgatatggtataaacaggaaaagtttggaatagagaacaaagatgagctgagtttgaaaagtcagctagtttcttactaaactaaatgtatgagcttctctctttaatcagattgggattggaagctctcttctatacaagtaatgggtgattgctggaaaggtactatgagtggacaggcctggaagtcagacactgtgaatcctaaagatttgttttaacaaggtgataagctttggctgtgtccccatccaaatctcaacttgaattgtatctcccagaattcccatgtgttgtggagggacccggcaggaggtaatttaatgatgggggctggccttttccgtgctggtctcatgatagttaataagtctcatgagatctgatgggtttattagaggtttccgcttttgcttcttcctcatttttctcttgccaccaccatgtaagaagtgcctttcgcctcctgccatgattcggaggcctacccagccatgtggaactgtaagtccaattaaacctctttttgttcccagtttcaaatgtctttatcagcagctttaaaatgaactaatacacaagccatatgttcagaacttggaagctcagagggcctaaaattgcacatgtgtgtatgcaagtccaggggatgcagattgtatttccaaagagtcctgttaagtggagaacattctcccttgaattattgagcagaagactcccccaactccatcaccccaagatctgctagttcaacgccctccatttaaagacggtagctactgttatacccattctacagatgaggaaaccaagacccaaagaagctaagaaacttgcccaaggtctgcgaaagtgacagaaagggacttgtgtctgtgtttttgttaactatgcacatcgatttgactgagagacatagcacagtttttcgctggtgaccgtttcagcatctgctaaccatgaaagtcaggacatgcatcatccatcctacctcactgttgcttcttttccagcaaaagttcagttttgtttgttttgaatttttaaaatcacaaccagaatgtccttgaggtattccttgtttgtgcttttatcttgtgagtatttgtttcatcctttattaaaaacatgtctttagaggaatcactgtctgtggtggttgagtgaaatgttggggcgacttctattttgctgatgggtttgaggggagagtggccttccacaaatgacacagtgtgtgtcacccttctgtgggtaggaacgcagtcagattgtgacattgttgtggttttctctctttcttcttcttctccaagtacaaacacaagataattatccaaaggccttttttttatgaaagtcttccaccacattccagaagtggccatctgtttttctgatgcactaaatgcatcagtgcctcatcttccagaaggttctgtgaaagcttattgctaagagttttgtattttataaactgagttgccattcagattgtccatagtatcaacttaacactggctccatggggacagaataagatattagttctatctagttactccagattgagtcacttgtgggaactctttgaattctaaagtttcctggtgtggacagggtctaggttgatcctaaagacaaaaatctttaggctcaattgggccaaattgttaatgatagaaccaccttctgtttgtttccccttctacatggtagggttagaatcctgcgggcctcctggctggggagcgcagctctgttttggagacagcagaagcatgtagcagcagagggaggtggaagagtggcaatggtttgtcgggcccctaggtgaccctggttctcctggcttggaatgctgttgtttaagagcagcagccaaagagggcgtgtggggaagaaggaaagcagccaaggaacattgaagccacaagctttagggaacagggctgggtgaggcaaaggggagctcttgctaaaccaaaatatttaactagatttcacttttttctgtcagtccaaattctttgtttgaaagtttcactttgaagttgtttcttttcttattgttccaaaaaatactgttgttttaatcttgtttctgggtggggccattgaccatttagattatttctaaattatagcattaaatgtctcaaattcttggggacgttttctgtcacaggccttccttggtgctacccggaatctcctgtctcaagtaggcaagaatatgtgtaagaacagcctggctgaaactgacaattggactctttagcaattgatatgtattataccttgcaaattttcagagattcagaaagttgctaaataggtacaggcacgtgcacacacacacacccacagatatatgtgtgtatatataccaaaatacacatgtggtaacatatacatgcagctcttctagacttctttacagagtgtttatgccagctatttctatagacaacatacattataaaaggcataataacagaggtcattttaaggatcattagacttttaaagaaatagctttttaccaaaaatcgtgtatacaaagaaagcacttttaatactttgtttggaagaacaggaggagaagactcctggtcaaaccacctagttctgatgacttagtttctcctgcatatgtcccacccccaagtattggatgacactgacgaatttttaacaagctcgacgccttatgtgagaagtgtctcttccctctttggcctcctagggtgggaaagcagatcccttctcgtccccaggcgtggcttccaagatgccagggccctgcgatgtgtgtctcatcagggaacacctctgtgtcagccccaaaggaagtgagttcagacgctccctggaattgcttttcatttctccctcagatatttagtgagcgccagacatttagtgggctcttactatggtcccaatcctgtgctgggccctaggatcacccagatgaataagtcatggttcaggccttcaaggtgctcccaggctttcaggggaacaagaagtgttcctagtgcaggctaagctgagcaaagaggaccggtcaagagatggaagccaggctatcttggtgggcagagccctgggggttaggaaaggcttcgccgagccagttttaaagttagaccttgaaagactgctaagaattggtcaggaagatgagcaagaagacccttccaggccaaggtagcaagagcaagtactaagggcagaaggtatccagcccatgatacatttgaagagtgctagtttgactagagtggcgacatcatgacattttaaaagtcaaacgggacacatccctgaggccatgagtttgaccttttgactataggcattgatgggtactgagacaaggaaggccaggaggtatacgtgatatcaagtataaatatgctagaggactcattgtaaaggccaggagttgactgaagactggggagaagggtccaccgttttgcagacgtcatttctccattccctgctacactctctttgtgccccaccctgtgctttgggctggaatcttccacagttcttcctgtttctcttaggtgttttttgtttgtttgttttgtttttttgttttgagacagggtctcactctgtcacccagtgtgtagtgcgagatcatagctcaatgcagcctcaatctcctgggctcaggtgatcctcctgccacagcctccctactagctgggactacaggcacataccaccccacccagctaatttttgtattttttgtagagacagggtttcgccctgttgcccaggctggtctcgaactcctgggctcaagcaaccctcccacctccacctcccaaagtgctgggattacaagttgagccaccgcatctgaccggaacttattttttaaagattgacaaaggcatgtgtcacttatgttaggaacaccccagcttaagtcctgcccactttatgacaactttttcaactaatccgatttgctccgaccttttttccccctctgaactccacttgcactactgtcagtatttaaaggtaggaccacttgacaaaccttagtaaaaccataaatgttactgggtacaagaatttcatgtggcttagttctgtctccgaagctaaattgtaaatctttgagactatgttttatatttctttggaatccaatctgttgtctctagcatggtgtaatgctggttacacagtatatacaagataaatatttgattgatttgctgtattttttttccatccaagtagaaatatggatgcttgtcccctgcggagagtccaagtcctctgagctgacatcatacacagagcccacttcctgtctaactattttttcacattgtcacatactcatgagcccctgatatgccaggccctgttcatccacatcataatgctttctcttcactcctagatttaaggttcaaacccaggcaaactgttgttctggccagaccttaaccacctgtgaggtcatagaaatgctatggagtatctcaagggtagaaaggcccttaaaccaggaatgctgcccaaatactaacgcaggctaattacatgccatcaagcccgtggtatgtgctcccctggcaaggccctgctccattttcttcataaaacctgatgaggagcattttataaattaagagctgttcccttctgccgctcagccgctccagtggactctggcagtgggccaggaggaacgtgtgtgcattcaagggcaaatgtcatctctctgcattgtgtggagaggcccactttgagccgaaacactgggagccgcataaagccccaatgtcttccccacaatgccccccagtatgggaagctcctttccagctgcagagccacaaatcttctcaccaagagacactttggctctctgtttgaccataagctctcacatctcaaattctaaaacatccaggcgtggttagtgtcttctttctgttatgactccatctggtgaaagcctatttcactttccttccaaagtgactgattttgggcagccaaagtgtttcttttttaagactaaaacagcaattaagattctgcagcattccgtggggaaatgctactaattagctacagtcaatactgtggattagtgttctgtgcaagacttactcactcagaaagctctgtatttcaaagtcttgctctcctcctggagtacctgccttctagtctttgaatggtcaaatcttaccatctttactagctcaggtacatctcctccaggaaaccttctgtgatttctgctatactccccttctgaattcccgtaggttttgtttgctcttctcttggaattcttgtcattgtcttctttgtcttaatacatgacctttactcttctgtaagatccttgagggaagaatctgtgtctgaatcatcataagccccacagtacctggtataatgccttacacatatgaggcactttctaaatatctggagtagaaaaagaatgattgggaattattaatcacacccaaccattttcagtgacccccaaaactggttcatgttatgcagtgatgatgatgacaatgacaattaaagtagtaacaacagccatcattaactgaacactcattacattctagacactacattctgcatttcacctgcattatctcagttaataccctattatcatgcctgtctttttttttctttctttctttttttttttgagacagagtcttgctctgtcgcctaggctggactggagtgctgtggcgcaatctcagctcactgaaacctccacctcccgggttcaaacgattcacctgcctcagcctcctgagtagctgggattacaggcactcaccaccatgcctggctaatttttgtatttttagtagataggagatttcaccatgttggtcaggctggtctcaaactcctgaccccaggtgatccacccgtcttggcctcctgaagtgctggcattacaggcatgagccactgtacccaacctatcatgcctatcttaaagatgaggaaacttggttttggtgagaataaataacttgcccaacaaccagtgagataattaaatgataaaatgagtgcatgttggaagcgagatttgagtccaggctcatgtgatgacagagcaagagccattaccattctgttctactaaagactatcatttaacacttcctgctgtgtgtgagagcagatcctctccctttattgcctcaatgattggctgggggtagtggggagaattgatgcatttatgaaatcagcctagaatggaagcctttagcagctagagaaagcactccaggatagctactctcacaccactccaggggttgctcccttatggcctccatggagcttccaagacaagggggcagaaaactgggtgagcatgtccaggctgccggactttgcaaggcactgtcatgggcctgccaagactctgctcctgttggccgctttataaatgactgtaattgcaccagtctttggtgaaagactttgaacttaataaaaatgtcaaactcattaagagcgttttcaagaccaaataaactctgaagaggctgtaatctttgatgacttcagatttgtgaatcacaaggacgtggaaaaaatctagctgccctgtacagagctactgaaatgtcactatttattgcttcagcgtcatctggtaatggaagtttggttgcgagatcagaaatctctcctgaaaatatcatagcactctttttctttactgtgtcaaagcagctgtgtgcgtgagcagctctgtatgtgccacaaagcagtatctagaataaacacaagtttgattagcctggagtcatgtccagaatctcattatattggaaatgtttaaagttagactgaaagggctttttttctcttcagggtagcttaggaaaaccatgtgaaaagcagcattattctggagaagacttcacatgatgtaggaggtgggatttcagctggatcttaaatgttgggtttggagtggcagagttctaggagacagaaaatgagttgtgggtaagaacagacaggaggggtgaggacagtaataaagaacaggggtggtctggagctaaaggtctttgtacttgagacactgaaggagccaaaaaataattaatatactgttagcaacttattatagtcctcttagatgctaaattatgatgtagacattttgaaaaatggtctcggccaggcgcagtggctcatgcctctaatcccagcactttgggaggctgagatgggcagatcacctgaggtcgggagttcaagaccaacctgaccaacatggagaaaccccgtctctactaaaaatacaaaattagccaggtgtggtggcgcatgcctctaatcccagctactcaggaggctgaggcaggagaatctctcaaacccgggaggcagaggttgcagtgagccaagatcacatcgttgcactccagcctggacaataagagtgaaactctgtctcaaaaaaaaaaaaaaaaaaaaaaaaaaatgaaaaagaaaaacagtctctatccccacagcaatcctataaggtaaatgttacgttcagtttagagaccactaaaaccaaggctcctgcaagcctgtacaggcagaaggcagattggtggctgccaggggctgggagtagaagggaatgggcagtgactgctaatggttatggttatggggtttcttttttggggtgatgaggtattccagaattggatagttttgactgttgtaccactttgtgaatatactactgagttgtacattttaaaaggataacttgtctggtatatgaattatatctcaaataaggaggggaaaaaacataaggctcaaagagatcaagtgacattcccaagcttatgtagccactggtgagaaggcaaactggggtttgaacccagggctttctggctctaaagcttgtgctctttccccgctatgttgcctctgtcctttcaggacctgtgagggcttagcggtgaggttggctacaaacttttggtcaaagaataaaatgcatttttgctacaaatgcaatgatgtctgacaggtacaatgtagaactgatgtagagctttgctccttggttcagctaaaaccaggtttttgtcacaccaccaggaatgattaggaacacagacacattgaagggtgaggggaatggaatttactgggcaaaaagaaaaaaaactctctgcaaagcaagaggggatcctgctaatgggcccccaccgcacagattgaacaccaggtcaccacacaggaactaaagaagccaggctcctttccctgcacacagcacgaacttcccgtggctccaccccgttctcccagtgcagaggtgggtcagagattctccagggaccctcccctttatctgcctcctgcatctatcagaaccaagtgggtcatgagatgcgtagttaagttttgagtggaaggttactcccaagacactggctttgaagagagcaagaccaaatctgcaccccgccatggtcaggaggggaatcctaatatggaggctcccataggttcagggactggctgagcaagccgatgggatttttggtgcctgaagctggtgggctgtgacaggtagggtctttggaagggggccagattatgaatggcttgaaatgcctctccctctggtgggagaatttgaatttgacgcagtgggcatgggccatggtgcattaggaagacaattgctgttattggaaggttcttctggcagtatataaagggtgggttaggctgaagagagagtggtcagagaggctagctgtggtcatccaggcatgagttaaggagaattcagtccaaggttttagtaatggaaatggagagaagaactgaatatgggcaagaattagaagaaagaaaaaatagccttggccacagatgaaggagagaaaagaggtatagaacactcttaagttgctctcctttttaactttgggttttctaagactagaaacatgaaagtgctgaagatgggcatgaaaaataatggagaggaaaaccatggggatagtgaagataatgaaataagtttgggccctaatgagtttggggtggtgacatgaagatttattaaaagttttgctagtgttctgcccagaccctcagcccagacaggtgcagcctttttcttcctcccactttaggaaggcaaggtctgattgatgtgccaatgagaaatatgaaagtgtaagaacactagaaattcaatgcatttttataacactttgtaatttacagattgttttgccatcttttattctatttattgtcacacagttttatcgtaatccttccacaatggttactttaccctacatgaaaccatatagttggacttactatggcattttattcagcagtttgagaatttcagaccaaatgtatttaaatccaagagatgacctcagatgagtgacacagggaattcaagaggaagaattagaaaggcctaggatattctaatgcaaggtaagacacccacacaagtacctggtgaaatgtgtattatctatatcaaatcagcaaatgcctcatttaaacttagaggagcccaaggaaagttctagcaagcaagggctaggaaatgtatatgtatcattcaatgtcagttatttactgttttaagttatacaaaatgtcacttgtaatatgcaagccagaagactgtggagtgtcatctttgaagtgccaaaagtgaaaacaaaaacaaaaacaaaaaaaaaacctgtcaacatagaattctatatccagtgaaaatactctttatcaacaatggcagaagaaatgctatggagaaaaataaagcaataaaggtcagtaggaaatgaatggggagtgggttctcagttttaagtagaatggtagaggaagacctttttgggaaggcagtatttgctccgagacccaaaggaggtaaggtggttgccatgtaaacaaaggggagaacattccaggtagaggaaataacaagcagaaagacccaagaaaggtgcatctcttacatgtttaagaaacaacaaggtgaccagcgtcactggaacagaaggatcaaggaagagaagataaggagataatgtcctgaagttgacagggaccagaccgtgcagggcattataggaagaataagtatatattttgtttgcctgggaccatccacatttatacctactgtcctaatattattatcaaaacgtcctggtttggatgagaaacttcagagtcgttctaagtataggtcatgtaaagactttggcctctaggtggattgagatgggagcccctgaggggtttcacccagagctctggctctaatatgatcattctgactgccgtgtggggaacagacaataagtggacagaacagaagaagaagtgcccattactaactactgaacaaacccaagtgagggggaagatggcttggaccacatggcagcagtggcagtggtgggataacagcaaaccttcagcctgaacagggggaaggatgaagtagccagcagctgtgatggggaagactgggaagaacggctttgggaggaaagatcgagaactagattttagactgtaaagtttctagggccttttggacacctaagtaaagatgtcagagagccagtgagtgtaaaagtctgaggtttgggagagcttcaggttggagatgtaaatgtagtattcaatgccaagaggcaagatgagattaccaagtgtagacagaggagagatggaggtcaaagaactgagccctgggatgctccgatgcttgaagtctgagaaatggggaggaaggcacaggagactgagaagtagcaaccagagacagagagacaaaaccaacggagtgagctgtgcctgaggctacttgaagaaagtatttgaagcagggaggagtcatcacctgggccaagtgttctgttaggtcagggaaaataaggactcatcattggccatcagatttagtgatttggcatcactggtaaccttgacaaaggaaatgtcttcatgtagtgagggcagaagcttgactctgggtagttgaagagaaaatactgtctctgtttttgtttttgttttttggttacttttttgttgtttttctgctctccctcttcttggttcttgcgaagagcaaaagacaaaggtgattcctccaagaaacctcttctaaactactttgtgcagtggcagggcagagagaccacataagttgtattattttctgttgttggtgtctggctccttttgggggtaggagtattttgcagcagtgtgataattaattttatattccttgtcacttaggcttctatggcaaagtgaatgcagtttggaggcacaaactccagcaaggaggcaggataaactgctcagaggaataagacctcccagaaataacatttcaaatggcaattgtttatttatttatttatttatttattttttgagacggagtttcactcttgttgcccaggccagagtgcaatggcatgatctcggctcaccgcaacctccacctcccgggttcaagcaattctcctgcctcagcctcccgagtagctgggattacaggcatgtgccaccacgcctggctaattttgtatttttagtggagatgggttttctccttgttggttaggctggtttcaaactcccgacctcaggtgatccacctgcctcagcctcccagagtgctgggattacaggcgtgagccaccatgcccagcctcaaatggcaattgtattgtagctgtccttaaaattgggagatcaaatctgaaaacattttggaggaggggaaaaagcaggactggatgacagcttggctttagggatgcatgagtggaatactctgaagattttggagaaaccaaaagctcagcaatgctccaacagaagtgtattggtaggaaaagatgggccagctgggggccacatggtaagttccatttggggcctttgaaggagatacaaatggagatacagtatcagagatgctctgacactggctgacaccagagagccgttatgcctaaatatggatccaggagtctctgaccagaagtggtggaggaactcgtgtttcacaggagaggtggaattttaggagcttctccagaggttggggaaagacagcttggctgtcttgagaataagtggtaatgaggaagatcacaggcagatggtccagcttgcaaaaatgctcaaaggcaagaatggatggcatttgtaaatgacaaggagcctgagaggtgaccatggtaagttaagatgttaacataggaaagtctcctgtactcctttgacgaactgccaaggcccaagtatcatgcccaacacttgaggattcaaaggtgagaaaggtatgttgtccacacttgaagtagttccctgtcattccggtgaaacagacgtgtgtggtcatcacagcacaaagcatgataaggattataattggggaatgaggagggtgctcaggaaagcaccggtgtggcagagccttacccaacccccagtcacaacggaggtgtggccttagagccgtactgagtagggcttaatgaggcgtgggtatggggcacctatgatgttttccaggtggacaaacatgagggcatgtggaagggcatgagaggtcctgggaggtaggagttcagaattaaggaagtgcctagaatctggaggagagcaagaagtgagtagagtgtgctcagggagaggaggacaggactcatgtgttatgtgcctgctgtctaacagtctctttgccaaggttttcatattgtttcagtgtagttgtgatctttccattttaaaaaatatatacttagcctgggctgggtggcttacacctgtaatcccagcactttgggaggccaaggcgggcggatcacgaggtcaggagttcaagatgagcctggccaacgtggtgaaaccctgtctctactaaaaatacaaaaaattagcggggcgtggtggcaggcacctgtaatgccagctacttgtggggccgaggcaggagaattgtttgaacccgggaggcggtggttgcggtgagctgagatcgcgccactatactccagcctgggggacagagcaaaactctgtctcaaaaaaaaaaaaaaaatatatatatatacacacacacacacacacacacacacacacacactcattgtagaaaaatgataaaactcaaaaagtagaaagaagaaaatcctccattgttagcgtcctgatgtacttctttctggattatataaattctctaccatcctttcattacttaacattataaaagggatttcccacattattacaaattctctgtcaacatcattttaagcaatctcttacacacatgatatgagcatgcaataatttatttaatcatttccctaatgctgtgcatttgagttgtttccagttttctgtaaatataaattaagctattataaacatacttgtctttaaatctttggccttgtttcggattatgcctttaggattggtttccattattggagtgactgggtcagaggccatgagcattttaagtgtcttgatccctatcaaaggtaaatggctttccaaaaagtccttctaatctctgtttctactgccagcatctcacctcatactctccaaaaatgaatattataatttaaaatttgctatcacttaatcctcatgatacaatcatgcagtgagtattctaatgcaatgactattatccccaatatgtagataaggaaagtggggccggtggatgatttcacacgccccatttcacagagttagtaaggcggtcagaaccaaggcctggtttggctaactcaagaggacatcagtctctccctgggcaggtgatgagccccacagaaggattttaaatctggaaagtgacataaagtccaggatccccttggcttgctcttcttagtgctggcttatctattggtaatgatctaaagaacattaactaccagctgacgccagagaactctttcttaacacactgttgttcttcagagcatgtatgaactgaagactggtaatgtgaagacaggggaaaaaaagaatagaggatgtaatgtaggttattaatgcaataagtaacacatatatgaattcatacaaattagttaacaaatacaagccactgcaggactttctaaacagcactgtatagttcatcactgtggaaggggtcatttcactaggagtaaagtcaaatttctcttagctcagccctgtccctgattcctcagcatctcttcaggttttgttcagacctgaaggtcagaggtaacagacttccagggccagggtcacctcttgatttaacttgggctgtggccagattagccacattgatctgctctcttggaagcctgaagaagccagtaatctcacttgggcacacatggagggagagagtataagaaaaaaaacaacaggccgggcgcagtggctcacgcctataatcccagcactttgggaggccgaggcgggcagatcacgaggtcaggaaattgagaccatcctggctaacatggtgaaaccccgtctctactaaaaatacaaaaaattagccgggcatggtggcaggcgcctatagtcccagctactcgggaggctgaggcaggagaatggcgtgaacccaggaggcagagcttgcagtgagcggagatcatgccactgcactccagcctgggcgacagagcaagactccgtctcaaaaaaaaaaaaaaaagaaaaaaagaaaaagaaacaacaaccagaactaccatgtattgagggcttcctatatcccaggcactgaaagaaagtgaacttgctcgggcatgcttggggcccagtaagcaagccaaattaaatacaggcggcctggcatggaatccgagactgtcatcgacaataaagaggtgaaaactgtttgcagagagatttaaataaactgtttcaaagtacatccagtcatgcacagtccttcgctaacttcaagaagagcacattggtgttaagtaaggggaaagcatcagattgataagtaactgataatgatcagcactgatgtttcagaggaaatatgtgttgcagagaggcagagaaccatggtggcattttgcccagtgagatgtgtcatgcccactacaggcccctcctttagagagggcaccttctgccatcttcatctctccccttggtttttattcattgttccttccagtgcaagaggatgtcacatttcatagatatatgtgaaccacagagacccaccttcatccagggaactgcaattcttaggaaggcactggggcatactcaaggcaatgagaattttttcacaacagaactcctgtggcaacaggatggaacttaacaaaggggactgccctttcagaaacagtctgtcctgcaacagcatggagatgacaacagggacaggttctacttagtggtgacagggatacaggcatcctggctccagaaatttataacactgtctgtgctcatgtgtaaacatgggtgacttatgtacctgtatatacttatatacatacatacatatttactgcaatagacacatatatttaatagactctccttccccatgctgtataaagtgcccatctttatagctctttccttacataatgaaaggtaatgctctgataatcattctccagatataaattggagggaagcagagagcagtaggggcagttatgtcatgggatggggagtctagagaggtgcccctaggtgagttgagatgtatgtagatatccacatgtatgcctacatgcatatttatatgtgtgtagatgtgtgcatatgtgtatggaaagaagaagtgagaaggactggggtatggaaaagattgcatggataaacaacgtgttaccctagattcttagcatacaactatttacagagggcttagcaatttttaaagtgtttttagacgagttaaaataaaaatcactggacttacagccaatacacttggcctgagccgtgattatgccattttaccagttttgcagttgtgcaatcagtaagtatgccacaaatagcagagacagccagtttcagcgcatggactccatttcccttgtgtatcctctgccctttgggtttcctagtgttgctatgctggtcttctcttttctgcatcaggcatttggagggtcttgagtgtttcattggatgtaaaaataatgccattttccttctagaaagagatgaagggtgggaccaggccagccttttccatttgctgctgcctacttcctgctgccagcccctaccccggcaaaaacccctatgctaattctcactcagcaacccctgtgcccattcacagtgaaaacgctacagtgcttctctcttttcagtgaacatcctatgaacacctgctttgtgctaagcactggggacccccaaagagctcccagtctagacataggagacacagatcaataacaagcaaccattgtgtaatatgacaggtgggcgattaatgttatgtgcagagaacagagaaggattaacccggcctggggtggccaggaaaggtttcagagaacatgacatttcagttggaaattacaggaggctttttgtttgccaagcgaatgaggacaaataaggcagagcctacagcatgggtgaaagccctgagtcaagaatatgcaagacaggattaaggaacagagaatattctgaaatgcctggatccctggggttgctggatgaggatgtaatggtggggaggggaggatgggaaatggctgtaaattagtttggaaaattgggcagggatgaggtcttggaggctttgaactgagcagttgagtgagtactcttcgccaagaactgcatttaaatcagttgagtattgtgtaccagctgcagctaagacttgtggggtcccaggaaaactgggtcatttggaagatatcccctcttagccatttctctggaaatggacaactctcaaagacttgggaaacactagctgtgtggtcagggaggggccaggaggcctgggagacctttggaaaggggtcatgaatgacctgacatctttgtgcttttgtcagtgtgatcactaaaggggaattaaagccttttgtaaaagatgtaatgaggctctctgaggtcagtcggatgagctcacaatttcaacaatcaccccccggtgggattgaggccagatttcttctgcaaacctcttgtgtaagatggttccttgaaggatttctgaaaataaatatttcatagaaaaagtggttgcacaaagagggaggatctggaattcaaagggcaggtcccaggaagcccaactgctatcctaggctcagtgaggttgctcaggttgttaatgtgtgaacctaacactgttaggctgttttctgggctgacacccatgaaagggatgggttccgtgctgcagctgttgatggagacaagagggatatgcagctgcttaaacttttgacacattgctaggggactggaatgggaggccattcaacttcctctcatgtctgctatgccttctgaatttgacaactcaaagggtcacagtcagaaagaggccccagctgtgaaattatttcccaacagagagtcaatgcattgatatggctcaaaggtccaagccagggtactccaaaaagcttagaacaaaatggatgggtgttgctttgctgaagtttctggtgattgctaactatggctaaagacagaactctattgccatcagtaggaagaagtaaactcatagattagttttttggcagtaattctatcttgagtgttattgtttgtttaataagggcccttgtcacatggtcacatgtaaatggtcacaggtaaaggatttgtggagtctgcttccttaattgaaaagcattgtgaaattcaccttgacttatggaaaagcaaatgcattttcatttgttaatggccctagtcaagggtgtagtatttgtataagcagaggtggtgaaaagcagcctctcccaaagcatgtttcagaacctcaaaccctgtgagtcttgcatgggaagagttttatatggaagtaaattcaagaaatgccgtgtattatgtgcccctcttggagattcataaggctcgctggcatagtaaagcctctaggatatcttgcactaaggaaacttggttaatttggtatcatttaacatttcccaaacttgtccctggatccattgtttgttttttcaatttttaacatttttttaagtcctgcagattcagaaccactttacgaaaccctgatttgaagaattaagacataaataggaggaggatgtatgggtttatcaattgtctattacaacttaatctttagccagaagatacatatggagccacatatataaaataagtcacaatctattaaatttctcttccttatctagaccctctcattttcacagctttctacatccacccaagcaaaactaaactgactacatcttcatttttttcctctgcaacttatttatgaatccataccttcaccagctattgtgttctgaagggtttcttctgtgcacacacaggatcatatctcatctaaaccataggttccatgcagaactctgtactccaataaaccagtcctgattaggtggaaaatagtatcatattttggccaaattccctgctgagcaatatgcctccttttatgtggggtataggtatagctcatctgggctttgtatatctgtaactgatatctgtctatggtctgaatgggggtttgctgcatgtagactagaccataaactcaataaatagacccttttctctatcctcgtaatacaaggaatattcattaatgcaacttttaagcatggaagccatctccagacagccaatttctgtggttgaggcaggaacagaatataaatgcttgttctctaaagaaccctattcttatctttctataaaatgcagcaactctattttggccaaacatttttctgtctgtcccaggttaaacacttcttcccaaaagtagaagtaagtacagagaagagtacctttgtttgggaagaattcgacccacttcttgcatttcctcgccaccatttacttcattctgtatccattccagcctggattcggccaccattactcttgaggacactagaagttgcctaattaccaaaaccaattgtcattttcgcctgctttttccacctcagagccttctggagaattctagtctcctgactgagaggatgctaagttttcctggttctcacacctactcctaaagtcctccctgctagtctccatcttctgtgtgcaacgtttccattcatttatctcacctatccccgatgacctaacggatgttgttttcagaaggagagaagagtaaattttggttcctaccttgtggtgtgtcacctcactgaaaagaacatccctaaatgtgaaattttaaaataatagtttctgaaaataattaaatccagaaatgtttgggttataagacatagttcaagtataggaagagaatgagaggtcaatattggttatgatcatggtagaggattccaaagaaaaaatgagattctgagtggagatgaagcatatgtaatgttcaaagagagcagcaacggaatacaaggaaactaggggatgattacttccttcttttgaaggagagaggcagtcagctggacctgaaagggaaagaagcatccactagtataagcaaacatcccagaggttcaagttaactgaggccgactcctggctaggacctctgcggagcatgcttccctccacgagttcttagaagcctgtgcatgaggtgttgcgcggaataggaagatgccaccctctctatcaaactactgcccaattttcaaaaacaggacctgagaaagagctggcattcagaatggctctcagattacactactttctatgtaaattgatttgtgcagatttggttttgtaagggaaaacaattggccaatttttttatagctctctacttctgcccacagacttgttcacttttcccttttacatgtaaatggaaaaatggaaatgagatttctgtgatgcatggaatctctatttttagaaaagataaacagggtcccctggtcagagactccaaaggaaaatatggttcccaaaggatggaagattaaaaataaaatgtagataggtacgtaagtaaattaataagacaacaagcaaaaacctgtaaattcaatccactttactgtgctgaggaatgccactgaaagaaaatgagaaccagggtaagaagggaaatatgcatttataaatttatataaatatatgtaattatgtattttatactatataatgtaccttacacagaatgaatatttttttaaacagaagctacttcttttcccattatcttcatcatcatcatcctttagaataagtaggtacagagtagaggaccaggcttcttccttaggccccaagaataatgttaacaatgtcaaagggaaacaagagctgtttcctcttgtattctgtcttttcctggatggaaattgctcttcacatgagaaagggtgtaaacaacagcgaaaagaggcctctgcagccctggctaggtgagaagatgaaggacccaggcatttaagatgaagttgggcttcccaccaacactcattgtgtgcaggttgagcccagcaccccagggaacgatgcctctttagtgtggatgaatatgttctcagaggcatcttgtttctgagctcctgtaaccttctgtgcattcatgtgactctcctcactgaatagaggctccttgagagcagaaattgtgtcttattcactgacccacctcacagcacaacatctggcccaggatagacacacagtacaaatgtgccaattgattgaaaaactgtaagactaaagatggacaaatgtccatgttttcaaaatggaaggtgggtataatttggaaaccacatctaagcttgatggcagttccttaaaaaaaaatctgttgaacagacagacttgaatagctgatcttaatactctgaaattcacctaaaaatggtcagaaaattggaactgaccttcagtaaaaaccactagtatgaaaaaaggtttaaaaagtgaatctaattgtggaatgtcttagtagaaaggtagggttctgagcataatcctcttatgttttgctggtcagactacatcatgttccattcttaggtgcttattttaagaaaggccttcataaactagaacatacccaagggagggtgaccaggaccagtaatatagggttccaatccaaagaggacaattgagaaagagatggcatgatttaacctgaagaagaacaggtagaggcagacaagtggtggcaacagtgccatcttcaaaacttggaaaatagggttagaacttttctgtactactcacaatgcagaactgcgaccagtgggtagaagtagtaaggggcctgaattcaatccactgtgaggaagcatttcctagaaaatagaattgcacccagacgcaaagagctctcttcactggaaatgttctagcaatggctggatggaaagctgtagatgagattcctgcattgggcaagaggcttggattggactgggtggtcttcatctccaagcatctgtgactgtttcacttcattcatcatgaataggattaactctctacgagaaagctttctcgattagggccactgtgcagcaaatctcctcgaaagcttcatttacactgttttctagatcaactgctcacagtaacccatgcctgtaataggggctcagaagggtttagccattagtttaaagggacttccaacctgttaccagggagtggccaatctagaattacttctaattattagaagataatttataaattagagaattgattcatattgcatcatgtgatatcatggcaaatgtcctcagaagcttagagtgataaaccaactaacataaactccaatctgagatttcttaccctcctcaaatttcctatcctccagttgatgttagaacatttaatagtaattttctagttttgcaataaaatcagatacaagccagaaacgaattaatggaagtatgtgaaattaaactaaaatgattttttaaatattttaatttttaaatgattttagtttaaatttttttaattaatatcatcatttgatttaacttctgtttttgtcagtcatttctcattgccttctctttttcttcttctccctttctttcccttcatctcagtttcctctaaggatttcaattttttaaactttcccaggactcaattaacctcacttaaacaattttttggtgggaccagtgaagtcttggagctgctgcctttcatactcagccgaaccctggaaaccaaatccgtagccaaacatttggctttggtttagaggcagaagtcagaaaggggaattgatatgcaggtgtggtgcaaagctggtcttaaaaatacagatgttattacctctgggccctaggggcctggaacaaaatgcagtgagccacccccggaggtgaaacgatggtcataaaatggtttctccattcgtgaattttgctgagctgcctctgcaacatttagtgactatttaataacactaacagctctttgagctaaattactaacatttgggggagcaaggttatgtaaaacaaaattgaattatgaaaacaattttccagttagctccagcgtttcttgatttctgtttatcttttttctcaaaggggccatttaccaattcccccctggctggcatgagctgatgtccaaagactccaaacaatcagcacacacctctgaacaacaagggtccgtatttttccatctctgttcctagcccaaagcttggaaacactttcagtcatggaaagatctaaaaccaagaaatatccaaagtggtcttctgaagaaaagtatgatgctctttgaaccctggttaagttttcataaaaattctctgttaacctaatgctgttggaggtcaccttgtttagatacagaaactgcatgaattgacaagcaaaagttaaagacagaggcactttctagtaaaattgaaaatgcacactccataaaagtaagcaatcccacttccaggtatacactttagggcacctctcccacatgcgcacactttaacagcagttaaaacgactaaactatacgcatatgtgtcgacgtggatagatctcaaaaacaacagagcgcagaaagcaagctactaaagttatgttaccaatatgcaaattgctaaagacaacacaaaatataaaatataaaagcagggatataccccggcatcacaggctgcctcttgggagggggtggaaatggggatggtgcaacaaaaggttcttcaacattattttattattaagagacagggtctcactctgtcacccaggctggagtgcagtggcacaatcacggcttattgcagcctcagcctcctgggctcaggtgatcctccaaccgcagcctcctgagtagctgggaccacaggtgcgtgtcaccacaccaggctgacttttaaaaaaattatttgtagagacagggtctcgccatgttgcccaggctggtcttgaactcctggacctaagcgatccgcctgcctcagcctctcaaagtgctgggattacagacataagccaccgtgcacagcctcttcaacattattaataatgttttgttttctcaaaaaggaaggtactttaaacaaaagtaacaaaaacttaatttggtggatacttgaatattcttttttttttctttttttttgagtttcgctcttgttgcccaggctggagtgcagtggcacaatcttggctcactgcaacctctgcctcctgggttcaagcaattcttctgcctcaacttcctcagtagctaggattacaggtgcccaccaccacgcccggctaatttttgtatttttttagtggagatggggtttcaccatgttggccaggctggtcttgaactcctgacctcagatgatccacctacctcagcctcccaaagtgctgggattacaggaatgagccaccgcgcctggtcttggatattattttctatatctttctgcatctttacatatcttacagatttttaaagagccaaaccaggatttaaattaaaaagatgaaagcattgtcaaacacccagaaaggtttctctgcggacccaggagagccaggatagttagcatctggaaaacaaggcaggccccagtgttcggaaggggcagaggcaccgggagagttacgtttgagcaaatttgttattttctcattcagtagcctgctcctaagattccataaatccttgctggatgacttatgtcctggtcccattctacttgcctgaaacaaagttttacccccagttggtgataatatacattgaaatttctgttgctcctatctattctgtttctttgtggctcaagttttctcttctctccgtgcattatattcaaacatgtaactccaaacagaacatacaagcatagggcacagcacgctgtctgtttcagatagaactttatttggtaggtggaaataaatgcatacacatggagggaggtctgtctgacagtaacagttcatttttccaactaattcaactgatacctgattggtgatcctgaccaaggtttgacgttgtttaactatttcttaatatttcttctgttcagctagtatatattcgacatattctccatcaagtgtgaccagcctagaagactagagttacatatagctctttagaaattcaggtgtagtcctagaagtcagtgagaagaaaaatataggatgttctgcaagttgtaatgatgtgtggtttaaaggcctttgagagtcctaagaaggaggcatagaggaaacagcccagcatttgaagcagacaaactgggcttcagagcctagctcagccactttagtacctgtgaggctttgggaaagttacctaacatttctgatattctgttttctcatccaaaaaattgagttgttaagaatgaagtgagctaactaatgaaaaatgcttaatatggtgtctaacatattattggtatttaaaaacatagttgtctggctgggtgtgggggctcatgcctgtaatcccagagtttcaaggggacaaggtgagaggattgcttgagactaggagttagagatcagcttggggaacatagcaaaactctgtttttacaaaaaaaaataataataataacaaaattcgccgggcatggtggtgcatgcccggagtcccagctactcaggagactgagacaggaggatcacttgagcccaggaattcaaggccaactttttgtctgatgatatgtcattagcagggcaccaagagtagctcattattcttgctgattaactcagctgaagcaaccttattaatgatagtggtgacaaataacataattagatctatgtactctgtgtataaccttgcacaaggcttgagaaatgaagcctcagagtggatagattcaacctgcacatatctgatgccatccttccaactttgcccacccctccaacatagacttattgctctggtgaccactcttagtagtggagacatgtcttaactctcaggtggggtagagggttaaaaaggctaataagcagcagggtcagtttctggctgggagtccaacctatgttatggtctcctttctggctgcctcctattgtgttattttgggcagataatttctttggctgtaaatttattgatctttaaaataggatggtaggacgttggacaagatgatttctggggtcctttgccccatattctatgttcatgatttcttttcctttgtaagtataattatacacccaaagtaccatggattatcaattctaaaatgcacaattgtttcacatcttaacatctaagaacccaggatataacttacaattaatggtaatttagattgctgtgaaatacaatatataattaaatgtgtgagaggtactaataaaaatactacttaattacgagtttctacaggaaaaattgaaaattgctgtcaagatattgactgaaaacaagcgtacattttttgtaagttcaatggagatcattaacatggaaaagaacccatgagttgctaggacagttgtcccagatgagggattgatttgggtgttcctaaaggtccctttcaaccctgagatgctatgaaacactaactttattccagttatttgttgttttgcacactcattcagtaactgaagagcattttggagaaaaaaaaaggtagtttacggggatgacatagtaatattgtacctattaaataatcatgtgtacatttccattggagtgttaagttattgatattctgattaactgttactatagctatcattcaataatattttcaaaaattaatagctatgtttggacactaaaactgtggtgaaaataatttcatattcattgatggctgaaaacgccttttagattcttgtagaagttcaagtcatttgctatgaacacagtgccatataacaaaaatattcacttgtgctctagataaatggaacttccatgttaagtctcagtaatagaggagatattattttattacaattgctaatgatttgttgttgttgagtttataggtagaaaaagaagccattagttacttttgggtaacttgttgcttgatttatcaagacttctttgtaatcatgatatattatctatcattaatcttacttggctgttagcatgactgagaatcgaagtgattttgaacctgtctcaggaatgaggcccagaggtgtggttcaggtgatcttggaggagctgtttagaaagcaattcccgatgccaaaagttgggatcagttatccaaagggctgtatttgaaggctgggtttgatttctgggtttccctaatttacaatagaaatctcgatttatcacatgtgccatgaatttgttactctgaaggaattaatcaaaatgttctttctataaacatttttattgattcatcatttctgaaatcatgcaatttatgagttggtcctattttgggtaatagcaattacttatgaaagctgctagagagtttctgtcaagtttaattaaaccttttctactggagactttttcaagagtttgtgaactgttgactgttgataccatgtcccaaatattactcataaactggaatttttaccagcaaaaataactcagaggcatcagtctcccaaatctggaagccagttgactcctttttgacaaattccgtatgtctctttacttcattgcaacttagcatttggccttgtgtattatttacacgtgtgattcacttttctctaacatgttctaaatacttttttcaagatgttcaatctactttttattaccctctttttgtaaattttaatgatgtgaaaagcagctaaggaccaatggagaagctcagaatagcaatttttgtaggaagtcctgatgaagagtttatcaagggagatttttaagtcagttatgaagcctgagggaaagctagaagtttagggagacctttgatcatacagtattggaaatgcaggatactgttagggtaagtgaaggctcaggataggcagaggtagctatggacctagattgaggggagatttgttcaatgggatctacattgagctgggcaggatttggattgataaagaaaataagagcaagccagagtgagccatgttccaaggacaaggaagaggagtcttttctgttgcagtgctggttggatggctccagcagtgccagttgatggaggtctcggtaatcaggagtccctgaaaaatattgagcagaggaaaatgtaataaaagccatattttaagaaaattaatttggtgccactggaaagaattggagggaaggggtaatgaagaggaaaactgagtgttaggaacaccaatttctattataataatcaaggagcaaagtgatgattaagacaataactaaggttaccagagtggtgccagtgttatgccattaatgacaacaactaccatttattgaatgtttatgtgccaggcattgtgcgaaatgctttacatagattatactctttaatcatcacaatagccttatgaaagaagtactttaatcccgtcttacagaagagaaaactgagatttagcaacataaaagtatttcccgtaagtaaacagtagagccaagatcttgacctacgccatctgatacctgagcccatgctataaaagaggagcattagaaatatttgaaagatagaaatgagaactagtcaatatttattttgcttagcactgtattcagtattatggcatcttaaagtagttaagactcaatatttcatcaaaaaagtttaaaatctaatcagagaatcggccggaagcagtggctcacgcctgtaatcccagcacttgagaggccgaggtgggcgggatcacctgaggtcaggagctcaaaatcagcctggccaacgtggtgacaccccatctctactaaaaatacaaaaattagccaggcatggtggcgggcacctgtaatcccacctacctaggaggctgaggcaggacagtcacttgaacctgggaggtggaggttgcagtgagccgagatggcgccattgccctccagcttggatgccaagagcaaaactccctctcaagaaaaaaaaaaaaaaaaatctaatcagataatcaagtcttacaacagtgaattaattcatgaaccagacagatgtcatggattggcttccctgggaaacagactttgagatttgtctgcaggaggtctactagggagagtgatcgagaacaacacgtgaagggtaagggctgcaagaatgatcaggtccaacagataacttaacatatcctacagggagttctggagccacaatgacctttcagagttgtcccaatagaagcaatgggacagggcctttatgcccctccatcacccaatcagtggataccagctgcccccagtgagaacacttgagcaaagcagtcctatgtgggggattcagctctgagtctccagcctcagtcctgaaaggaatccggactgcataccacagcatccacaacaacaaaatagatgaacatgttatatatttgaattatttaatcttcaatttgtaaacactttaaatcacatttttggggaatactttcctgtaaaagtagtttttggtggggaggaaatgtccaataaatctgccagtatatttctttgccatggagtgacagccttagttcttgatgaaagtaatcaatatggaaggcattttgtgtgtggcttaattgaaaccctgtgttttggactcatttggtgttaatgtgtaaatccaatcctgttttcacacctgccctcttttttttatgatgccttgttcaagtggaagtctagtctggctttttgcttcagtctaaagaaggccatggactgttgtcattggccaggaatccaactcatatggtggcatgaagtcatccttcaagcccagcaaaaagaccctgtcagccttgcctgcagagaaagccatgtgaaagatgtcctgtgctaggatcatctggtgagcaatccattatactgtcattgatcttgacagatattgggcatacatgtacacctggacttcacctcctaaagaatctgattcctggtggctgggatgggatccaggcatacttatttttttctagtgggccagtgaagagcttgttttgttgttgttttgtttgtttgtttgtttgtttgtttgagatggagtcttgctctgtttcccaggctggagtacagtggtgccatcttagctcactgcaccctttgcctccaggttcaagtgattctcctgcctcagcctcccaagtagccaggactgcagatatgcactaccaccccccggctaatttttgtatttttagtagagatggggtttcaccatgttggcctggctagtcttgaactcctgacctcaggtgatccacccgccttggcctcccaaagtgctgggattacaggtgtgagccaccagccacagcctgggccagtgaagacctttgataaatccatctattctacagggttcttggagatgagattgcctgttgagtatattgggggctcttcaagagactaaatctcaaagaaagagcttcttgaggaactgaggagtaccatgtagaaatgagaaagaaggtgaggagaagtttgaaaaattctgcactcaaataaaagagaaaaacaggaggacaaaggacagagttgggtactagagactatgataaatctctaagattcttaggtcttcttggttactgtcattcccatatccattactcttagatgaaagtggtccttgtgtttatcttgacaaatagcaaataagtgggaccatgcaaacaagcattggtctcttttattcattcatgcaataagtattaattagcagtaactatattccaagcactgtgctcaatgctaggagtgcaggatgaggaaaatttagtctgctcagggagctcacaattccagggtggagggggtggagactaagaggtgatagattgctaaggtagagaggggcacagcagctgggatagcacagactggcagtccataatcctgtttagagagtcacggaagacttcctggaggactctgcaggattagaaatgggtaaatcaaatatggttttgtcattcaaaattgtggcacatctctccagttatttagatcttcttttacgtccttttagaggatttttatacatttttctacaaagatcttatacagtgtttgtgagcttaatttctaagtaattcataatgtttggtgctattgtgaagagtatgttattttgcattctttttgtggttggttattgttggttatagagacgtacaatttatggtatcttgtaacttgcaatcttttggtactctctaattctcagagttgttggattttattcggttttctaagtaagaaaaacaacatctgcaaacaatggcaaccttttctcatgttttccagcactaatacttcttatttccttcctgtgtgttattgcacttatatcttattgaacaacatggtgactgtgggcatctttgtcttcttccagaccctcagtggaatgtgtattaaattttctcttttgagagtggtggtttctgtggaggtaggttctggtagaaaccattttcagattcataatgtgcccttctgtgtctaagtttttctaagaatttttacactaaatatgcattgaactttaacagatttttaaagcatcaaaagatgctttatttaaattgcatcttttgagattcccatatgatttttcttctgtagtaccaatgatggaatgaattacatttagagattttatccgattttgtactatccttaccttctgtgataaaaatcatctgattataacgcattaccacattaacataccactggatttcattatctagtgttttactcaagatcatgacatttcaaaataggtagcattgacgtgttattttctctgctttcactgttcttatctagctctggaatcaaggacatactatgtcattaaatgagatgggcagctttccttctttttctgtactcagaaacaacttgtaaagtgggaattatctgctccttgaatgtttgatagaacttacccataaaactgtctacgtctaatatttgaggaagggaggtaggacataggaagattctctgttatatgaatttagtccatggagatttgtctgtatacattttctgtttcttttgtgttggttttgacactctttttttttaggtgttcatggaagaaaaggaacatgtcctgaggttacagaaagggaaaggagagctatcccattgctgggcagaggactgtcagaatagatgtctgtgtgaaggggagttaaatgttccttctctgatcagtgtgttctattcatccatcctaaggagggaacctcaagaggaagatgttcagctcatatgggtttgtgtagtatgtcacctctccgacatcttcatctgtgacagggccagtagggctgaatcatggcattggcttttgatcagtgacttgagccccaggcatcaaagggccagtgctactgaaatgactttcctcagagaatctgagcttgcacaagctcaggccgtaccacaacaccattggctgtaaatggcagccccttcactagatgagaagtaggtttagcttttagaaggacacatgggtatcaaataaccagttacttgccttcagaggagtttgaccaaggttataggggtccagaaatctcatatgaggaccgcctgttggatctgagctggaaatgacagtaggggaaaaatatttctcttcttataaattaagaatccccatggaatgagaattacagattattttcagggtattgtacaatagggcaggggagaggaagattttggttcagagtaaggagagattttttccagttgagctgtgagtcatttgtcactgaagagtttaattatatggtggtttcaagcagagcatctcctgggtcaaggcagaaatttggttttcacaatgaacaggaacttcatgtgggggttaccagcagactatgttttcaggaagacaaagctttagaaaggttcacatatggacaacctgataaacgttcgctgggcccttccatattccagctaagcattctcttacccttaggtaagtggcagagtttgggtgccccagagtcatgggcacacagtaggatcacctgggaaacattcaacaagttatcatggccaggcctgtgccagcccaagtcagtcagagtcctgtgggtaaggcctgggcatcggtagcttttcaaagccttcaaagtgattctaggatacactcagggttgaaaaggagagagctttgaaaggagggaggattccattgacagaggagcagaagccttggatcatcttaatttcattaacaagggggtaaaaaaggaaaggctgagaatgacacacagccttacttgaaaccttcttaactggatagttttatgttcacacttcctcatgtttcatagcaaccctatgcattatttattctcatattaaatatgaagacaccagagatcagagaaattaacttatccaaggtggcgcagcaatcaaggagcagaacgggaatttgaagcaaggtgcaccaggtctcagcccatttggcagagaccagggctgctcaccctttgggacgcatacacgagtccccttgggatctggttaaaatgcagattcctcttcaggaggtttagggtgaagcctgaggttctgcatttttaacaactcccaggcaatgttgatgctgttagtttgcaggtgacactttgcgtaacaagggtgtcaatacactttgagaatcgaatcttgatcttgatggagacgttcaagagtctttgattacagatgaatttggtgactcttccccaggtgagaaaacagaaaatccatgcaagtttgggaagcccccaccttgactcacaactgctgcttgtcctgctgaggcaccagccaggcatccccgggaaacaggcagaatgaggctggcagtgacagaaatatggttggtcatccagccatctaactaatatttattgagtgcctatggtgagctggagactgttctagacacttgcgatgcgaagataaacaaggcagttttataatctagtggtgtgtgtctaaagcaaaacagttatcacggggtttggttacgtttgtaacttaccagacccttgaaacaccctgacttttctcactctgtcagcctctacatccaatctgtcaccgggttggctcaatctgaataaacaatgtagtggaacggccagaaaactcatgggggctccctctgcatgaacagcagcatactgaactggcagtagagacccgcactgtctgcccagtaaggctgaagctggacaactgacagccttcaggtctcccagccttatctcaatgtggattgcaacaaactgggcctcatctagggggcagggcggccagacagtagaggagacccaaacccttttgcatcaagcactgttgagagacctggcagtgtggaccctgcttcaagacagaagagccagtgggaccctgagggcctttccgcagctgctgggcctccgtgttccctgtgtctttcaggccacactcagatatcacccgccctaactatcccagctaaagcgtcctcctcagtcactctccatcacattttccatttgtagtttcttgagaactcagctctagaggatgtgacacataaagagatgctcaggccccctggttgttcttttgtgatgttgggtagacttgcgtcttctacctccccacaccccactccacatcccatacctacattgttgcctcagcctccctgtaagcttctctttgtttatttacctcccttgcccccatcccaaatcaaatccatcctatatgtagctgatagccctgcttttctatacttttttctcatttgggatgcgtggtttgcaacctcagctctcaggagcctatttcctcgggttactctggctgtaaggtagtgatggcttggctctggaacccttggaggcgcctttgtacccgcaagccacgtggccaggcccttgtgtgctcagagaggggcctctgtctctcttggccggctttgctcctcctgtctctagttggaatctcttgacattttccactttccaagcatcaaacttatgtctttgtaagctggctctcaatcatgttctttcttttttaaaatttgttgctatctaactacactctaaagtcccccagtaaaaaaagaaaacaaacagacaaaaaacagaaaattctcctttaatcaatgcttgctgtcttaactggtgcttcagacaagcacttcttaggcaaatggatgaccacatggctattccagggaggggaaacggggatgctaaattggcacagagctctgctctgtctcgtcacggcactgcctttgatctttaatttgagccattctaggcagggctcagtatactctgaaaacacactttgtgattaaaaaatgtgcagtacatcagccaaaacatttgtttatattttacccccaattttggggtttcttgtcatgctttcctcaaaaactttctttatataattaaagaggtgtgagtgctctgagcatgactgtgcaatagaatacaaagcacagttcccttctctgaagacagagaaaggtttttccccatctattcaagcatgaagtctgtaaggatatggcacagcgaccttcactgcattgtttctggaatggtaatgacagtctgggctgtccaggaaagagcgagcttcacaaagactaaggcccttccaggagggtctctcccagctctggggatcccctcagagacacatgggtgtttgaatgcaccagtgtgtgtctctggttctgtgagagcagggtttttcaacagcagcactattcacatttcagaccaataattctacagtgcacaggatggctcctcacggcaaaggtttctccactccagctctatccacatttggccctgaaggttctttgcggtgggggctgtcctgtgcgttgtaggatgtttagcaatacctgtggcctctccccaccagatgccatcatgctctcctccccaaccaccaactggacaatcaaaaacacccgcagacatttcccagtgtctcctggggagggcaagatctccccgcagttgagtactctgcattggatggcttggaaaaggatccccctaggtaagaggcacagtctgggtgccccagagtcatgggcacacagtaggatcacctgggaaacattcaacaagttgtcatggccaggcctgtgccagcccaagtcatgcagagtcctgtgggtaaggcctgggcatcagtagcttttcaaagccttcaaagtgattctaggatacactcagggttgaaaaggagagagctttgaaaggagggaggatttcatgacctccattgacagaggagcagaggccttgaatcatcttaatttcattaacaagagggtgaaaaaggaaaggccgagaatgacaaacaccctcactaagtctctgtgtttgctctttttgtcgtctttagtggttagtagaactcttaaaatgaagaaggcctgtgctcttttcttctggggtagctggaagggaagagctggggagatcaggtagcacctcacagctaggcttgaaagaggaaccctaaatgagtaggatgtatcttagagattttgaaaaggaaaagtatgctgagtctttgaggcctcagagaaagaggccgaaatagcccaggagggcttagccatcagtccttggctacgcggttccagtcaactgagggtaagaaatttgcttctgcagtgttggctggggtcttgtgatgtcccaccattttcctctaggatacatgagtcccagaccaaaaggagaagaaaaacaatgggtgctgtagtgtcaggtgtctctgggtttcggttcagggaactatcattccgtccaatatcccaagctacaaaacctcctgtagcacggaaattaggagcatgggctttggagtcactacagttgtgtttagttctcagctttgtgtcttactagccgagatatcttaaagaactaagctacttgacctgcctgagcctcggttttcccatctgtaaaatgggaaatataataatcatacctatcttatagagctggcagaaaaagtgaatgagataatccatgaaaagcattgagtccagtgctcactaattattaactactatcattagttcttgttatttggcccaacattcaagaagtcctgtttccttctcttccttggaaatgtattttgaaaatctgaccccttcttcccatctctgttggcgttgcctgagttctgtaccaccagtcacccttggggttgaaaaggagagacctttaaaggagggatgattccgtgtcccctcctgatgactgtatgacccctccttgatctgccacccagttgacctctctccaggtgttaccgggtcatgtaactcttgattcaaatttccagggattgtttgcaaccaacaggctgaaagccaaaagccctatggccagaacctacttctttggccactctgtggtcctccagcatgttggaattgttagtttgggttcccatgaccagagagtgttgactggcttttcttgcttatgttttaaatgtctgtatgttttcaagtcactctaagtgttggtggagtgaactcccctaacccacagtttatatgtcttggactgaagtgttgcacatttttgtgtgtgatgttttaaatataaaattttgttttcccagcaactgctgtaagtgatttggaaacattgcctggtcctgattaacttcttttctgcatctcatttagggtcttgtttatttacattaataagaagactacacaaacagcttacatgtgaaattttctcttgaggacacagaggctgacgataaaggctaattcgtgagtgagaggaagttgaaatctaagttctttcagctcttgtctgagcctattgctgtaacaagtctcctaatcaacagaccttgttaaaggcagttattttattacaggcctcccaagtttggcagcttacccgacagcttgccttttttcaggaggcaggacatcaaggtgaggcaagaaagaaaagaggacaaaaaggaaggcatttaggcaaggcaaagttggtctcttcaggttcttgttgtaagtcaacccccatctattgtgtgtataaatgatcagccccacctgtgagaaagataccacagaggctgaagacaggtctaactgggggaatatagtgccttgaatcaaaagcagtatttcttcttttctttttctttctttctttctttttttttttttttttttttttggagacagggtctcactctgttgcccaggctgaagtgcagtggcgcaatcatagctcactgcagcctcgacctactgggttcaagccatcctcccatctcagcctccccattagctgagaccacaggcacatgccgccatgctggcttatttttgtatttttcgtagagatggagttttgccatgttgcttgggctggtctcgaacttctgggctcaaacgatccacctgccttggcctcccaaagcgttgggactacaggcataagccactgtgccctgctgaaagcagtatttcttttgaagggacaaatttggattccttgaaacatacagctcaaatggatatttgtataaattattaatatttgtctttcagttcatttagtttcctgctgggttatgattatcaaaaattgtaaacttgtctatttccctctgctagactggcagttaaataacaggaaagtcagagtagcagaatggatatgggcatgggatttaacaacagataagcctggtctagtccaatgtccactgcttaccagactcccagcttggtttatgcccttccacaaaaaactagctccatcatctgtgaaatgaaagaatctggctgggcacggtggctcatgcctgtaatcccagtactttgggaggccaaggcaggcggatcacctgagatcaggagttctagatcagcctggccaacatggtgaaaccccatctctactaaaaatacaaaaattagcagggcatggcagtggacgcctgtgattccagcgacttgggacactgaggcaggagaatggcttgaacccaggaggaggaggtttcagtgagccgagatcgcaccattgcactccagcctgggcaacaagagtgaaactccgtctcaaaaaaaaaaaaaaaagaaaaagaaaaagaaataatcctagtagccacctcactgggttgctgtgaggattaggtgggattgcataagtaaagcagttagcagagtacttggtatagtcaacccatggcagccactacagtgacagggaggatggttttttaagttccttgggaacaccagtcttgtatctgcatcaccagcttctagctcagtatctgggaatgagagtgtcggaaatgaatacatgaaagtcccagtctttgccatctttagaatgagtatttaggtaagcacaagcacatctgcgtcccaatgccatgtccactttggctgcagctggacaagtaatattcttaaatccccataagatttaggagaagggatcttccccagggcatcagtcacgcagggaatttgaacagagagcagtggctgggggactgtctcattgagggaatgggtgggaagaacaaggtaaagaaaggtcggtcagaaatgagagagtaagatctcctcggaagtcaagggaggaagttctcaagggagatatgctgctccacggtggcagcaagttcaaagagaaggtcattccatgtacgccttacgcatacctatgtggagtcactcatttggacacccagtcttattagagttgcatcgtgccatacattcatttttctctattttgattagcagctattgaagagcctttacccaccatgacaaatgaatactccatcttaatggctgtcagctgggctgtggtttgctgccattgtttgccattgtttgcacacaaaagcctgatcccattaagaccgtcagatatttcctgccatcgcatggcctcctgctcacaaacatttgatgctatttaaagcctcttctcagcaaatatgcatcggtcacatgtatgcactgcccattaattaaggccagatttgaagctctcacagctgtcacttctattaactgattgcagggaatgtaggacttcatttttctgggagataatgtgaacatcggagaaaagccaagagatcttcgaatccctgtggcacttaccttgacttccaggcttgtaatgaaaaagcttcttagacaaaaagggacaaaaagaccctttcacagaaatcataaacaatctctgccaagcaggagatttagtgggtgggaacacacacacacacacacacacacactctttatttgaggcaccctggaaaatgaaaagctatctggggaaagtaatcatgtgagaagatggccttgaagatagcagcttgattttctttgaaagaaaaaagtggaccaatttacagtagtgactttgctaaaaggctgaaaagagttgagtgtattttctcttcagtctctctttttctaaaggaaacacgtcatggattgattggaaaacatgatcttctagttatcaaatgctttaattaatggcaaatcaaaaacataccagacaaaggttgccagttatcaaaaaatcaaatactaattttctcccagctgcatgattgggagcaagggtgtggagctggaggtgagactggaaatagtcacaatcatgatattaatggaattaacgtttattgggtgcccacaacatggcactttaaaagaatgcattttcataaattatcttatttgactcttgaaaacttagatgttatcatatgcccattttatagatgaggaaactgaggcttggcaagcttaagcaattttcccaaggtcacccagctggtagatggcagggtcaggactcagatctcagtgaagtctgtctgccatgaagttcctgttcataaccctttgttatcctggtacagtggaaagcacgtgggctttggagacagactagagtttcatccagattctgtcatgggaccttcaacaaattgtttaccttctcctcaactgaagtaaaatgaggaaaatagaccaggcgcagtggctcacacctataatcccagaactttgggaggccgaggcgggtggatcacttggggtcaggcgttggagaccagtctgaccaacatggtgaaaccccatctctactaaaaatacaaaaaattagctgggcatggtggcaggtgcctgtaatcccagcaactcgggaggctgaggcatgagaatcgcttgaacctgggaggcagaggttgcagtgagccgagatggtgccactgcactccagcctgggcaacagagccagactctgtctcaaaaaaaagaaaaaggaaaagaaaaataatagctgcctcatgggctactacacagattcaatgaaataagggtaaacaaaaatcagagatactcaaagtgttagtttaggggtattctgcaccccacctcccatttcatttcattccagttatttctttctcctgtcactggactgaagctcccaccaccttccgctatgttgttcctgcattctccacttcctcttggctctttgtcttggggaccaacacagagaaatctttttttgcccagttcttcccagcagtgcctgcagctgtgcctttgacaatcctgaccccagctggtccccgaggacctcccagcctcccacctctctcctcagactcccatgccatgactgaaaaacaggaggacctgcgaggcatgtgagaaatctacaggcttgacatctgtgggccaggcgctctctctcaatatttttttctttttttttttttgagacaaggtctcactctgtcacccaggctggagtgcagtggtgtgatctcggctcactacagcctccacctcccgagttcaagtgatttccccacctcagcctcccaagtagctgggactacaggcacacgccaccatacccagctgatttttttgtatttttggtagagacggggtttcaccatgttggccaggctggtcttgaactcctgacctcaagtgatccacccgcctcagtctgccaaagtgctgggaatacaggcgtgagccacagtgcccagcctcaagtccaattaactatttttcaccgttgtttacagagctttaacttctcatttgctttcaaagcacctgcatttagaattttagatgataactaagatggtttgcattacaaattcttaaaacatttggctttcagaaaccatcttgggctgtatacatggagaaaatgcagtcaagccctgaagcccagggctaggagacagcaaaggaaagaaaaaaagggaaacatggggagccatgatctcagtgtcgtggaaggcagtggcagagaatagctcaagagatgagggatgagaactgagaagaccccacgtgcagggaaagtgaagctactggcatcctcagggaagaaatgccagtaacctggtgagggtagcagtctatggcagaaggttaaaggaacaatgattatgtggaagtgggaccagcactgtggttgcactgtggtcgccaggggctgggggaggtggcaatggggagttgttgtttcatgggtacagagtagaggtggatggtagagtgatggttgcacattatgaattttttttttttttgagacggagtttagctcttattgtccaggctggagtgcaatggtgtgacctcagctcagtgcaacctctgcctcctgggttcaagcaattctcctgcctcagcctcccaagtagctgggattacaggcacccgccaccacacctggctaagtttttgtatttttagtagagacggagtttcaccatgttggccaggctggtctccaactcctgacctcaggtgatccacctgcctcagcctcccaaagtgctgggattacaggtgtgagccgctgtgcccagccaagagtatattttaataccactgaactataccttaaaaggggctaagatggtaaattttatattatgtttattttaccacgtttttgttttaaaaagtgcaggaagcatcaagcttggagccacagtgaaagtcaagaatgtcagtgattccacatttaatatctacatttttgcagggcagttactcttttgtagtataacattgagctgatagcacatagtgtagacaagtgaatacaggattctctgggttatatttccagaagtctggaggtcatttggatatttgtgggcccttggcttcactctgacttgtgtgacacataaaaattgtgatgaaatgtcctatagatgtcctgcaggtcttaaaagaacctttccaaactatgaaacagcccagcagcactgagttagaggtaaattctgaacccttgaacactaaaactattctaactgcacatagaattggcaagtagcattctatgtctatgaacagtatgtcttttctatataacagagaaaatctttttaagcaaactactcagtttaaaacctaattcttctcataatctcagtacttttgaatgaagacatatcagtgcaacagtacactcttattcaggcatttgaaagaaagaattcgagatctagtttgtatcagatattataaattagtatggtttagtctttgtcatgaaattctacttaatttttggactataggtttaagaatgtaagcagaagttctgcaccaatcagaataagctacattatgcttgagtgacaactactgtaatgacaaaatatcagtggcttaatacaatggtttttctctcatacttgttcataaagagtcagcaaggaccctgctcattatggtccctcagggacccaggttgttggaagctccaccattttagatagctcccttcaaagtcagccatctttgcagtcatgtcccccaacagctgcaaaatttgctctgatgctcaagaattgagcatcggcagttaaatgcttcaacatgaaagtgacacctgccactcccactcacatcccattggccagaactagtcacatggccagacctaacttcagaaggttggagaattgtaatcctccatgtacccaaaaagtagagaagccagatactgagaaacatcaataatggctaacagaaatccattctaccattccctttgcctaaagtgaaaagatgagtactttcatcaatttgtaaactgtacttttgaagtaaatcctggtagcttgcatgggggctggatttccagaaagccatatgtaatttgggaatgacattcacttaagctcatagaatatcattatttgatgtaaaatgcccccatttgcaatacaggaccaaaatgcactaaccacaaaattccactccacaagggtctgggttctaatttcttcattctttaaatgaggcattctatgatttggaatggaagcccagttgtagtcgtaagaattttacttaattcaagaattattctcactgaatatgtgccagttctgaaaggaatgcaaagtcaaattttgcatcttctttgctcaagggcctttagatgtaacaacacagacatgatacaaggctgacaatgacattatgatttaaatatgttaaacaacttattaaattgtgaatcaacaaaaaattatgttctttattttatggttttgcatagtcctgactcactgcctacatatccctcttgttcctcagctcttatccctgatttcttacaggatggcctaagacagctgtagatgtttttatttagcaaaaaaaaaaaaaagaaaagaaaagaaaagccaagccagaaaaatatgttactcctgttaatgttttttccttattcaaaataaaacttactttagcttcatgagaaataatacatcttacaatatatattactgacttttttcagtaaagataggtcaagaaagaaattgtactgctcattagccaccaaaatactagtattgggggcttattggaaaagtggtaacaacggcaacttttttttgcaactttctttttcttttattggacagtctcactctgtcacctaggctggagtggagtggcatgatcatagctcactgtagcctcgacctcttgggctcaagcgatcctcctacctcagcctccctagtagctgggactacaggtacacactgctatgctcagctaattttttttttttgtagaaatagggtttcaccatgttgcccagggaggtcccaaacctctgggctcaagcgatcccccaacctcagcctcccaaagtgctgggactataggtgtgagccactgcacctggcctaggcaaatttctaatcctaaatagtgaaattagagggccaactgtggcaaatctaggggataatttatggcaagagagccagggggttgccaggactggtctcaaattctcccgtattggattaatttcagtgatgtaagttgaggccactgacccacatgactccttcagaaccgagagcaggaaggacagcatgacatagataaagtcccaagccatgctgattattgtttaaaaacttcaggctttccccaaattgcatgatatcttaatctttgatttcttcttattttaagtgtaaaaatccatccctttattttataaatcctgattttgccatgaagcggtctctgaactcctcagctgttactgcccagtttatcccttaattccaattccacctaccatgtggttcatctcttgtttatctccccagctagatattaagcccattgagagcagggatgtaacatatgccacttttgatttctctaaaggaccaggtcagtgctaggcacacggtcgatgtttaattaatccttcattaatataacaagtcacctgatgatttagatctttccttcaaaacccacctacagacacacacacacacacacacacacacacacacacttacacactctgatcatttagtctttccctgaatgactccggtggtgaagagctcacttcctcccaaaacagcccttccatcttcagtcaactgctaatgtaatgagctaagatttactgagtgcctactatgttccaggcatggtgctaagccctttacagagattataacattaatccttacagcaatcttttgagggaggcattccctaaggctttgtttcccaatcactacgtgggatcagtccttctataccattcctctgtaagccccagtccaatgtcttgggaccacagataggaaatctaatctttcttccaagtgacgaagtttccaatgtgggggctatctagcaatgcctgtcttcttttcttcttgttaaaccccccaggtctttacaccattgttaacaacaatcactgagtctcattgaacactcactgtagtccaggtactgtgaggaaggctttctttttgtgctttaaattattttttcccatttatgattgacagaaaggttatgcgtcttgcctgaggtcacacagctagtgtatggccaacagaactgcaatcctggaggggtgtgattccaaagacagagtttctcattactgtttggcatcatttctacttatggtgattttcactgttttaacagtttagaatcccttatgtcactttcataataaaagggagaaaagggcaaatactttgtcacagaaagaagattcattaaagggatatttttaagccactgttttcacaagaaaaccaaatgctagaaaaggtacaatgctaaaaagaaactgtaaaaaaaaaaaattgatacctataccacagtaaagttattccaggtaatttaacttttgagctagaaaccgagggttctccttgcatcagggtgctctcaccctgtagtcctgagaagacgacctgttttaggcaaatacataaaaccaaatggaatatattagaaaggaagtgtcacagaccagtgtccaaaggtttttggagggcagaacgtggagcaatggaccgtacacagagagaagaggatttattacaagtcaggatcattcagggatgaactggcttccttaatgggtggaaggctgcctgtcaccggagaaagtcaaacaaaatcagatagacagggctcttgcaaggacagaaatggcttagaaagttaccaggcacccaggagatcatctgaaggtgtgttaaaagttaacattaagagtctaggttcttttagaatggcaatcattaaaaagtctggaaacaacaggtgctggagaggatgcagagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaagaaagtgtggcacatatacaccatggaatactatgcagccgtaaaaaatgatgagttcacgtcctttgtagggacacggatgaagttggaaatcatcattctcagtaaactatcgcaagaacaaaaaaccaaacaccgcatgttctcactcataggtgggaattgaacaatgagatcacatggacacaggaaggggaacatcacactctggggactgttgtggggtggggggagtggggagggatagcattaagagatatacctaatgctaaatgacgagttaatgggtgcagcacaccagcatggcacatgtatacatatgtaactaacctgcacattgtgcacatgtgccctaaaacttaaagtataataataataaaaaaataaaaaagagtctaggttctgggactggaatgcctgggttacattcctgctcaacatcttactcatcttagacaatttactcaactgcctcagttttctcatctctaaaattgaaataatagtatgactttcctcttggggtactgggaggagtcagtgagttaatttaaatagtaaaacatttttaaagtgcccatgcatatgctaaatcatctggtccggtggtcctaacactttttcatgaaaatgatcttgtttccaaagaaaagagatataagtaatcccaacacataaaacaaattttttaaaaccactaatgtgttttgttagcataaattaatttcttttttgagacaatttttaggttcaagagtacatgtgcaggtttgttgtataggtaaactcatgtcacaggggcttgttgtacagattgtttcatcaccccagtacgaagcctagtacccaatagttattttttctgctcctctcctttctcccaccctccatcctcaagtaggccccagtgtgtgttgttcccctctatgtgtccatgtgttctcatcatttagttcccacttgtaagtgagaacatgtggtgtttggttttctgttcctgcattagtttgctaaggttgacggcctccagcttcatccatgttcctgcaaaggacatgatcttgttctttagtataaattaatttctaattaaaacattaacatctaactcttatacaggcatttagtgaacatgtggctattttgtccattagaaaatttagcacaagtaatatggaaaatgatttggatgccttagcgtttactttatttctgaattgtgtttcaatttacaacctttgaagagttcttaattaacataggcaggaaattacagacagtctctttggttgaataaaaatgggagcagtttgttccaaaggctgcataaaaatgagttaatgcagagatgtctggtgtgttacacgtaggcgtatactgtggttgagtatatatgatgtttatcacagttcttcacattttgaaaatatatcttaaagattatgaaaatactgaagtagagccttggaatagcttgaaagccactgacctgtctcatttagcagacatgatttataggttaaattagccccagtgactgtccaaggtctcaacagaaaacagtaggactcaggctaacaccagggtctaactgattgtggttaaaccagatgatctctatgttttcttctgttctaagagtctatgattctagcattctatgtttagtgggaatacttgccaataagcctgattttctatgataagcctcttcttccttcaattggttaggccattttgttcttctctatactacaaatctgttacgaaatgaaatttcagagctatattttctgaaaaggataaatgtcctttgctccaaattcattttatttttattcctatccacttcagtttgtataaaatacagaattctaatcttcaccagcaagaatttgtggtttttcctaatacaaactggtaactgtaagctccagatttacaaaaaaaaattcaaatttgactttcacggccagctaggtcaatactctatgccacctttgtattctgttcctctgacattttagcttttattttttaaaaactggttcaatatgttgctgactttgagtcacagcaaggaggaagatggatatcttcatctatgctgctgacatggttttccagccatcctaagaagtgaataaatcacttttactggttactaatctgaatggctttgtatcaatcatgtcaccattaccaacttatttgaggcagggatttctctagtattcaagtagacacttccaacaacttcctctagcagtccatttcacccctcagctcaggggtaatgccttggttagttcatggaatccttaggcggcaataacggttcaaaatgaacattatactgcagctcctagtaagttatggatttatagcctgcccctgctcaagagctccagaagttccttcagcttaaaggtaataggctgtttttctatcattatttaaaaacacaagtcgaacagtgatttccttgcagccctcaatcatatacagaatacagtctcaaagctggtacctcagggctcaaaatggggagccccagggtcactagggtgactcaaacccagaggaaagatggtcttggggtgtattagcctgttttcatgctgctatgaaggcctgcccaagattctgcaatttataaaggaaagaggcttaattgactcacaattccacaaggctgaggaggcctcaggaaacttacaattctggtagaaggggaagcaaacatgtccttcttcacatgatggcaggaaggagaagaatgagagccgtgcaaagagggaagcctcatataaagccatcagatctcatgagaacttaccatcatgagaatagcatgggggaaactgcccccatgatttaattacctcccaccaggtttctcccaccacacatgagatttgggtggggacatagccaaaccatatcatgaggaaatcctggcttgtcatcgaaatcataccatggttttagattccctttctgataatcgaagaacattctggaggcctgaggcagagtgagccaccagaagaaataggagctgtccaaaataatttaaagtcccaggcccttgggtttgctttggggaaaaaagcttttatcacagccttttggtgcaacagaaaacaaaatgtttgggagaggttttagtaccagcacttcaggcagtgcatgtaggcaatggataagagagaactcaaagcttctgggaaattggaggtgtcccatgtttataaaggggaaattcaagatgcaattaagacgactcctttccaagaaataccaggacaaagcaagtactccaaagccacccagtgccactttccctcatccctccacctgtccaacacgtgcacctttcagtgggtgctctgcacttgctggcatctgctattcactaccatattccctgtttcaatcactccattaatctccttgcctttgtggcttccaccttaaaactctgcttttgagtttttgaactagatagatacgagcacagatcctagcacttggctgtgtgacctcaggcaagttacttaatctccctctttcctccattattaaaatggtagtaaatacattcatcctatcagataagcaacaaataccagtttcttttctttatattgcttttcttggtgctcaggagcacctctgcacacctctctgaatagagggagcacacttttcttatggaacctaaagtcaccagagtccataagttgtcaaaatggaatccttgattctttttgactttggctctttctctcttttaaccagagtttgttctctgctggagaaatgcttttcattttacttccatatttgctgccgtttcacatttttaaaagtatattcaggccattctctagctaaataacattccaatcagctactgtttaagctgggaattgatatcatttatttgtgtttctttgaatttgccctctatgttatctttaacttgactttaaataaaacataatatgcattgagttccttccatgtgtcagatgctttttacaaacataaactggcttcatcatcataaaaccaacccagtaaattaggagatataattaataaatagtgtcactaattattacgtattttcactttatgacagcaaagtatttttgctgtcaaagcataaggacactggatcattgtcaaaatccctaccttcactcagttgtccacacctgggttaaggcttattcttgagcggctgcagccctgggcactcccttccacctggaatcagagaatcacatataggcataatgcctaggaggaagtaatcagctcgtttaagtgatggctgacatcaggaggccttttgagccagaagaatgacatgatgatagctgtgtctttggaagataaatgtcacaaccacgtgcagtatagattacctgaaaccacaacatttagcctttatgcttacacatctggggggcatgatttaaaagctcataaatacaatctggattttaaagaagggactggtgaaaattaagaatttcaaggttctaccaaagaaggtgaaggatcggtgtttttccaactggtttatgtgtcctaaatatttatgtatacaagtgcatattgttagtgcagtctcttggaagccatgtgtgggcagcagatctgctattgccctacctttcagtttaaagttgcaagagaacggaaattctctgccagcatgagaatcattcatctggcagccacctgaattactgttaagcaacacattgagtttgacagataaccctgttcttagccatccttcaagaaaagcatgaaggagccttcatgtttaaacatttcagccaaatttcttccttctgacaatgcatggaacacaatgtctttatttcctaatgaaatattcatattggatgtatctatggttagaagagagaataataaggaattatctttatttaatttcttagtcattctggtctcagagagcaagctctcgggttgggtaatgacgtcgcccaaggaacctgatgtttttcattgagttataaatatctctcaacttggcaaaccaatagttcccattcccaggatgacaaatgagaaaaatcgttactatttcagtggatagttttggatctaggaatttgttgtgagaggaagggtggtgttatagatgtcccttcatggggggtaaatcagcacaatatgggacttcagaggacttcaatatgggattgcaagggaatcaagagacgctataggagatgctgaagcagtgtggccaggcctcgtgggaggggaggcctcggattgggagtaaagcctgtgtgtaagcatgttggggaaagcccgagagcagcctgagagatataagcgtataggtggcccttggtcagtcatctaccaggccctgttcttacaagaagggtttctgttgtcccaagagacaatacaactagcagaggaaaaagatcctagacttcggggccagaaggcacttatttcaaacccgccaccatcacttctgtgtgagctttgacctattacttaccttctcagagctttggcaaaatagggatagtaattcttacctcctggtgttgttgagagaattaggcaggataacatattaggtaaggtgccaagcacatggtgagtggtccagccgtaacagctgtcacatatatccatggggcttcctactgcctaaatccctaccagatgcttgaatgccctgattgcatctgttttccacctacaactcatctaagaccatgaccctacatgcccaacccataggctccatccagcagtctcccttgctctgtttctaaaatgaaaataatccctttccagttttttaggctttccatagctggtctccaagacaaaccgggaaagactaccaaaagaaagcattttctttaagttttttgttgttgttgttaatgagaaaagttacaaagataaaagaaatctctggaagccttgatcaccattgtcccagagcattattgaaatgcaaatagattgtgacagtttacctgttacagctctgtcttcaaacaccacttgagaatcatgtgaaaagaaaggggggttttggtggacagtgcaaatacacaagcctcccctgttggtagagaagtatatgtagcttgtgtgaaaaaggggatcccatggccagactgccaagggacgcgtctcgaggagaaggagaggcacaacattttaccagcccctacttcatgccagttctgaattaggtaccttcatttacacatttcatttaagcctcacaagagatttgtgaattatactttgatccctcattttacaggtaacaaaactagggctcagaaaatgatgtcacctgcgggtgtaatgtgcattattaggaaggctcttaggtgaacattcatgtgtctagaagaaaagacgttttgaacatatggaacgtagaaaagaaatttttgttaaattctttaaatcccagcaagtgcacttcagattcaaagtccttaggagtccccccatcactcagagcttctctttggctcttctccaccatctcctagtttctcctctccctttcctctctgtccctttcctctctctccagcactggaagcaaaactaggcttttctatttagccagatctcagggcttttttgtttgttttttgtttttttgagacagagtttcattcttgttgcccaggctggagtgcagtggtgtgatctcaactcactgcaatctctgcctcctggggtcaagccattctcctgcctccagcctctcgagtagctgggattacaggtgcccaccaacatgcctggctaatttttgtatttttttagtagagatggggtttcaccatgttggccaggctggtcttgaactcctgacctcaggtgatctgcctacctcagcctcccaaattgctaggattacaggcatgagccgtgcaccagcctgatagcttcttttgctatgcagaagctcttaagtggatcccatttgccaatttttgcttttgttttgattgcttttggcatctttgtcatgaaatctttgccagttcctatgtccagaatggtgttacataggttgtcttccagggttttggcagtttggggttttacatttaagtctttaatccatcttgagttgattttttatatggtataaggaaggagttcagtttcaatctttgcatatggctagccagttatggcagcaacatttattgactagggagttctttcagttctgtgatagttcatttgctcttcaaccatttcctggtgaaaacagccaataaggaagtcagaaaaggactgccagctgcaagaagtgacttctgacatccagaggagggacggcagagaccttctggtagttggaactacttaatatagagggtggcaatctctcacacctcagaatgtctctgagtcatctagagcaagagtcagcaagttatagcccatgggccaaatctagcaagtaaaccaaatctagcatgtgagcctaatccacctgccgtctgtttgtgtaaataaagttttattagaacatagccataagtcatccatggctgttctcacgctgcaacaatccagcagagtggctgcaacagagaccatatgactgcaatgcctgaggtatttactctctggctctttacaaaagaagcttgctgacccacaatgtagagcagcacctttcaaacctgaatgtgcataggaatcacctgagaatgctgttaaactgcagattctgattcagtagccctgggaagcggtgcaagacttctaaaatgccccagacgatgcctgcactgctggtccatggaccacactttgagtaacagggggccagagaaaataaactaaggcttattgtaagattctccccgggggcctgaaagcttaaggagatgaataactcctcccttctcaggcccagtcccaaggcacaaggctacttgcaccagcagtgtgctccagcaaaatagcagaagcaggaagagagccagccggaagacacgtacccctgaaaatcaagaaagaggccatccgggtacaacatagcagtaatgtcagactaggacacttcctgtttacaggagactataaaactttcgccctgtcctcacttggggctgacgccattttaggcctcagcccgcctgcaccctggtgctcattaaaacagcatgttgctccacaccgcctcctgttgtctgttggcacgctctcagggttcgaaccagtacaagaaccttacacttactagtcttgatttttttaaaaactgagaattataaaatatactttagaaggattcctatccaaaaagctaaaataaaaatgcatagggttttagaggaaaattctgatgaaagaatgggagagagagaattattataactaaattcgatgaatgaattaatgagtatcaagatctatgctcagacccttgctgtaagatggctccatcaaaggcctgccccccagtggagtttctgcctcaagaacactagtattctttcaggttgtcaggccaggaaccttggtcttccttactccacctttggtagaacatccatcttcagtccagttggccattccttcagcgtgatgttggtgggcccttgccctccattctaatttcatctctctggtccaggcctccatcactttgtgcccatcttaatgcagttgtctgtgtgtgtcccagtctccagtctcttccatctccagtccattgcccgtgtttgccagacatcttctgaaaagagctcttcagcctgccatttcccactcaagagtcttcggatttaagatcccacactttcgttgccagccttttctctcatcatctcgtcccactcacccagtcagtcctctcagccgtccctggagatggcccaatgatagctaagaagcctatatattccccaatgttgtaactcatttacacagattttaaagcatttttcttgaacattttggaaatacaagatttgaatatttcacccacctttttttttttgatgttccaaaaaaattttaagaaatgaaatcatgccttaacaacatggcagaaacttgcacataagagcacagtaaatatgcagtcagcctgcatctctgggtccacccttcttgtgtttctcaacagtcattgtttttgttaatgttggatcactgcttcttgtacttaaactagttgtttaggtaagtaccctcttgcaaaggcttagaggtgccatcttgtggagaaaaatgcaaacaggcacatttggctgtgtgttaaggaaatgacaaagatgccggcgtgaatctccatcattgccttctggccatggggacggtcccgtgagagccttctggggacctgcattggtagacacaggccatctgcgctcaggaggccctgtaaatcaggccagtgtgcaagcaacctccatcctggatcagagttcatcaacccaactcactattgcctttttgctgataatctagcctccagaactctgccttatagggtgtaggcagtgtctctctgctccattctgcaaggaacttcctagtcttgaccccttatcagccccaaaccacagcttctaacagacccatcccacgtggttttttcctgctgccagcccctcctgagacactaaaaaattacaataaaatctggccagacatattatgatctctttaaacacaattcaccatacggctctacacattaaaagtaaagtgaaagtctagaggtttctagtattctatacaaaaatatggttaccttacttttataatagagcaattatcactgtcaaaagctatttcaggcctctctcctccttcccccatttcaatccatggaggaggaaaattatgaaagtaaagcattagaattttagagtttgggatatccccaccctccagagaacgatgacccttgttggaattgggggaggtggtaattatcttacagaatatgatatgtttacctctcgggactcctttcttcagatttgtaaacatagctgcagttgattcttacccagttttatcctacaagagcgccaacattttcttccagttgagtcccttgataagatgctatcctattatgaactaggatgaggtactgaaaagtgacagccataagcttgattaaaaccagatcgctcgttttacaattgctttcatttaggaagccaaaataccttttatgccatggaccatttcttctcttcaaatgaatggcatcgtcaatttgatcttcattgattcctgtttccaatttaattttgtgtatatacagcaaatttccctccctttaaacatggcaggattcttcatatcagggctgtatctctttttaaaagaaaaattttggcaccagaagggaccttagagatgagccagttcgaagagcaggttggtcctgtaactttgatcttttgattcttcaaccagctgctctttcattcaacaaacgcttattaaacacctaccaagtcgcaggtactgtgctctttgcaatacataatgatactcctgctgaagctaagccaagaggcaatcttaaagaactcgagaaggtttgatagcagtaaggaactatttttggaaactggataattaagtgttctttgcttattagcttctctgacatttacaaaggctgtttgtgcacttctgtggaactaccatcattttaaagctttctggggaatctgtcatgtgctcctcggtgtcccatgagctttggaataaagagcagtgattctcaactgagggtgattttgctcccatggggaacatttggcaatgtctggagacatttttgtttgtcacactgagagggatgctcctggcatctggtgggtagaagccaaggatgctgctaaacatcctacaatgcataaggcaacccccataagaaagacctttcaggaccaaaacatcagtagagctggagttgagaagccctcaccttgaggaagaagagcaggcaggaggatgagaagctaggtttctaaaccctgacagtccttcaaccaaagcagttctgctcttctcattttgcatagtggagctttggatttccacatgagattttatttttgaagtatatttttttctacttaaaaaagttgaagactactgtggtagaagacaactctctgccttctgttttacaattgagtcactttggaacaaatcaagtgggtgtatatgatacaggatgagggcagtcaggggtagatttggaagcatctacctgagccttggttttggctgcacaggactcgacatttacaaacaatattgaagtgatttgattgtgtctgactttcaatttagaccagggattggcaatttttttctgtaaagggccagatctaaatattttaggctttgtcgactttcctgtttgtgttgcaactacttaatctgctgttgcagcacaaaagcagccatagacaataactaaacaaatgggagtgtttgtgttctaataaatctttatttataaaaacaggttgtgagccagatttggcctactagctacagtttgctgacccctgatttagactgtaaataggaaccttgtttgttttaccttcatgtctccgctgcctaccactgaattggcacgtagttgaagttggctcaggaaacatttactgaactatatcgaaggtcagttttacaggcataagtgttagaagattttaatgagaataacaactggaaaaagatccacccagaatagattaactgtttccttatgttgaacatttaggatgtttccaattttttattaacaatactgtgatgagcccttcatacagaaactgttggcctgatttcttatttcctggcataaattcctagaagaagaatttactggatcaaacggtctatattgctaaattgctttccaggaaggtggtattgatctacatgcctaacagtaataacaggaagatatttatcatatacaaaggatttctttcaacagaatgtcatgaataaacgttttggcatccatatgcatttccacgaattagctcaccgtaaatataagtaaattggtgtcagctactaatcattttaatattctcccatactgttctaccagcatgattattaaggcacgctgttttacctgtgggggtcatctagccaaacagttgaggttaccctatctcatgtgtttactgagcacacacagacacatctgcttcccattagggaatcaggacctccactatctgaatgcctggcaccagcctaccctgctgtgaaggacagaggcctcctccctgtgaaattcacctccaaatatgtcatccagattgctcatttccctcaggaaatttcattcaggttaattttggcacacaattgggggtaattcttgagcaatttctcctgtgatggcttgcgatgtgtaaaattttcctacaacgtgttgcagaaatcactggaaaaaatacaaaggacatctgatggttatccactggtctttgtaacagcaagaaatatctattctgaacagcagtacacgatgagcaagaaacataaaataaaggtagatcagagagtagatgttctttctggcctttttcgacaggtaccgtttgagcagtgagaatgtagaagctgtatgaggtgtcttgactttatggtgaaccttggccgattttgttttgttttgttttttgcacttcaaagttttctgaatttcaccaaatgaagaagaaaatatttctgactaagaagtagtagaaagtgttacagaagtacgggtgggtccgggtggttgtatgatgatgagatttacttaaaagtgaatagacttcagacaaaataaaatacataaagacaaagatgacaaaacccagcattttctgagaagccaccatattgcagaattctgctaattacattctatgtttgcctcatttgattttcccaacagtcctaaggggtagctgctccatccccatccaggcagaaaaaaaatcccagggctcagaacagctcatcaaaatgtccaaagatacagcactcgtcagcagcagagacagcacaagaacgcatattctcctgcccacccaaagcagtggtgcctcggaaagagtctagacataggtcagcactaagtcgtccctatcagcgaccaattgatcagcctcctgatacacaaaccagaattcaagccagattcgtttctgaacactgtccttgggaagaagatctggatggtggtggaaatgttttcagcacctacctcaaagagaagtgaccaatccagcatcacacaacaagccagggactgggccaggactgcaccccaggttttctggtttgcagcccaacattctttccattattccaaactgtttttcctgataaatgacatcagctagtgattatacctaatgattatacagctgtgttttggaggagactatcggctgctttaaagaaagtcatagcacgtaatctatacatgtgataatagttcatgaaacatcaaaaaaagtgcatctaaaagataacaaatacaaacaaggcctattcttaagttaatagtagtatactgctgtcaatggcatacatggttttgacaaagtgctttggttatgtaagatattatcgttagggaaagctgggtgaaagaccaccgaaactctctgcgctcattttaaacttcttatgagtcttacactatttcaaaataaaacattataacaataagaaagtaatgcaacaggaagatgggctagaatatgtattcacacactgtgtataaagtataatgttaaaagagccagtgtaagagagatacataatggggttggtccctcttaatcctgcaagaggagaaagccagagtcacttctaggccaggccctctccaggcttcatggtaactatgctttgaacttgttcctctgcacctaggtcactgtcacgatctactccttcaacaaagctagaaccctcaacacgacctccgatcctttgacctccgacttttacctaatggttaaaaacatggactttgatttggggccttgctttaaatccaagctctatctattattagcattttagccttgggcaaattaacctgtcttctaagtcttagtttcctataaatttcagcaatctcacagatggctttttaggattaaatggaaaaacatatatgtttccgaggacctagaagatagtaaagactgtaaatgttagacatgataatgttgaggaagatggcaaggaggaggatgaggacagtcagaaaggcctgttcattttgcatcctaagcatctctcaaatcccttcacgccatccccagtcccctcattcaggctgggatattgcaacatcctccagactttatgtacccaattgttaattatcgactttctaaaggagatttgatcctgtccagcacgacatagagcatgcaagcgttcctcatggcctgatagcttgtgattctctatgtgtatgtctgattgctcctgttagactcagattcccaaagtcaggacctgtgtctgattcagcttgggattttccaggcagccttttcagtgtagtcactcaacaatatcagtgatgaaatgcatctttacgtgtttcgatcttgtcatggcaggtccttcatgtcattcagatcctagtccagaggtcattccccagccatgccctcctagacatctagtccaattcttccctcattacatcatctgatcttcacaacagccctgtgcaggagaagggacagttgtcatgtgtgtaatttgcccttggcctcagctaaatattaaggtcttgaatatgtgttgtctgcctagttctcattctggagttgtccctcttgctttgtgaagtaaaggagagatatttggtaactccatgggaactcagtctcttagaggcctgggtagccactagaacactgaagagtgctcctagtatgttctaaggaagctattgatcatggctcccggtagacaggctgtcacctttagttcttggcatccttgtgcagccgcatgcttcactgaaaccaacctccaggctacttcgacatctaccaggaaaaactcttgcagcctttccttcccatgtctagattgatccagagcaaccatgctctgcaggaaatctggtgggggtgtgtccatcaaactgtgcagagcattttcatataatgtctgattcacaagatcaaataacattttgtctgtgtctgtggttatctgaagctatccatgctagtgtaatttccttgtgatagttccattctaactgggctggggctgaggattaatgtgattaatgtgacgtctgtcccatctttggcgactctcattcattcttgaaatatctctgacaccctagttacaggagagggactcactggacggttcattgtctccactctaggtaaggcccgctccacactgcagtcattgttaccaccgaaaagcaagtctgagcatggctctccccttctccagacatctgggggttgctgatgccataggatgaaaatctaattcttcaatctggcaaacaagattcttgacaagttccgctgaactctccagcctcgtattatccctcccagcaggcttgcacttcagccgtgtcattctgtgttctttcctacctgtgtacacattgttccctttaacagaaggacccctatgagaatgagctcagtctggacaagtcgagtccaggggtagcagcaacagactggaggttgggaagggagggagtgtgagatgtcactagacagggcaggcaatgggtgttgaccacctctcctgtctaccttcccccttgatgacagtcagaggcatctccttgattcagttggaatcttgccttgataacatgggttctactattcaaaacccctgttgatggtgacatttttgttgttgttgtttcaaagcaagggagaattcaaggggggtggggctatggaaatcacacatggaaaacatattccttattttttctgctaaaatgtgcgtggggcagattgagaaggatttgagggaggagaaatacatagcaaacatggcatttggaaaggctaattggatgtggatgagcatattgagatgatgttctattactgtcagagataatgttttacagagatgctatttgtgaagagagaccagtcattattgatgggtcaatgtgcgcttgggaatatggaagcaataatgcccaagggcagtgcctgcagaaaggtttcaatcaggcatgcaactagaggggaaggaatgggcaccttttgatttgactctgcccacaggatttgacctataggacctacctgaagagacccagggttgcataacaaaatcaaaagtggactttgactggtttgctgctcactttgtcctagagatgtggtctgattattgcacttagaattcaagaaagaggacaagcctgtgatttggagaatatgtgtctcaagaattagaataccattctgatttcaagtatctttccatatcctcatgacccagtgaataatcctgtactcacaatatttcattgtccaaaccataatctacccacttccatctgctcatggaaaagtgacagaattctttgttcagaacatgagtcccaattttagattcaggaaacatgatcctgagccctgtgaggtcaggagtggaaagcttcagaagtagaaaaagattttgtgaagatcattccattttgttccaaagtttaatttttggtttttttaaaatagggcctgctctgttgcccaggctggagtacaatgatgcaatcactgtagcctcatactcctgacctcaagtgatcctcccaccttagcctccctgagtagctgggactacaggtgtgtgccctcgcacctggttaattttttactttttgtaaagactggatcacactgagttgcccaggctggtctcaaagtcctaagctcaagcagtcctcctgcctcagcctcctaaagtgctgagactacagacatgagccaccatgtctggcccaaagtttaatttgtgtgtgcgacataaaatggtcccaacggaaacatgaatgaggagggagagataaagcaaaaagatcttagaatgagtaatgggaagattccttttgtcgggggagggaattcaggaaagtcagaattcctttatacactgatgagaccagctctacagacagcactctgtggtttagcaggttatgatctcgtttgttgatgattctggctcttgcttaccttcatccttctgctctgggaaaagtgctctggggtaaccaaggaaaagtcctgcttctgaggcctctagagccacagttaccagttagaggttcagctcccaaaccatttaatttcctaagaaactggtccagggaacactacttttggaggtactttgctaagagtagcatctataagaagacatgagggcaaacttcagtttcagatgtggcacttgtcatgattccagagagattctttatataaaaatcccagcacagaccatcctctccccttccagagtccaacggggattttcagaacaacttcactgtacaacctgtttaagtaaatttctagcaccctacatcttccctagtctttttcccagtgttatttttctcctgatcatttaccaccaccaaacaaactctgttttatttacttgtctggtttaccgtctgtggctcccaccccactcctagaatatacatttcgtaaatagctagaaaagaaatttcttgcccagggatcttctcccttccttcctctgcatgctcctgatacatactatgagtcttttgttttctgtctttttgcagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttgggtaagcttggtctttttccagagaaaaccgtctgtccctgccagatgatgtattccttcagaactgtgagatagacacagcagtgtccgagagtcccggggcatgcaggcagtgcccctggggaatgtcaaagtaccacctggcctgcgccttgaaatgagaagcttgagtggagaacgttaaaaaaaaagtccttcttgcagataaatacttaatatctatacatttaaaccagcctttgcttttcccaagagaaacatggttataaagtggataacagcccaaattattgctctgagatgggagaagctctttgcaaagcgcggagaccagccagtgtttgttctgttgggatttgaggtggccagggacaattgatcctatctataccttcactccctggaggtctaaagcgaagccatttttctcttctttctgcctcatctgcctggggcagcagacctatacatagtagtgtgcatgtcttctgaaaagctgtggaatcctccagcaatcattttgggcaacatcatcaatactgagaggccaattttaacccatttttctacaaaagatctttgttgatacttccttctggactttggagctatttgcattccatctgataaaaaccacaagccaatcgaacacattatttatttatttattttttttttttgagacagaatcttgccctgtcacccaggttcgagtgcagtggtgcgatttttgctcactgcagcctccgcctcccaggttcaaatgattctcctgcctcagcctcccgagtagctgggaccacaggcgtgcaccaacacacccagttaatttttgtatttttagtagagatggggtttcaccatgttggccaagctggtcttgaactcctggcctcaagtggtctgcccacctcgacctcccaaagtgctgagattacaggcatgagccaccacgcctggccttgaacaaattactttttatgaatttctaatagatgtaagcatgtttaaatcagttaacaatataagggagccatttgtttaatgaatagctatattcatttttatcttttaattatttattgaacaggaacttacctaaaacaaactatgtgtcaggcactattcttaatgtgttgcaagcattcaatctttgaattctctcaacagggaaaagaagctattcccatccccactttacatgtaagaaagcaggcacagagagattatgtaccttgccaagctcaccataccataacgaggtggagctggggttcagaccaggcagtctagctccaggtgtagtagcctgtcaagagatgatacccatgggcagtctcagaacctaagttcctctggtgtgccactggccgtgcagcagtcaatggctgcagcacttgaaagactattaagtctgcaactttcaaatatcaggatcacccacaagttaactccagactcgggaactccatattctacagctcttccatccccatctagtcaaatgcagccaaaactaagtggttttacggggggggaggaggaagggatggcagatgggactcagagacaaacccaatcaaagaaaaactgttcaatttgctttgacaaaacccaggagccaccagagtgtcagaaaacctagtttcccagtgagtgctttgtatattctttttaatactgaaaaatagtgtttgtgtgtttcctcctttcttttgtactgctatgagatcacatctccataaacatcctgcctcctagaatgggaaatgttcttctggggattatttgaattgtgattgtgttcagatgtaccggcaaacaatgccactttttattagctttgtgttgcttttagtacattttccctggctatagttagttgtattcagtaagcagttttcaagctgtgccccctgaataaaaaatagacattctgggtgaatatctactggatgtctgaatggaggaagctctcggaggcttgttgttttcatctggagtatgggaataagaatcttcaccttataagtagtcatgcgattcaataggatacagatatttcagactcggcagagcccctgacacctattaggcagttgacaaatgttcattgcctttcttttgtctcagagagattgtcagttttgattccatcaaaattgtggaataaacatttcctctttccttaaaaaagatgaagggaaggcagagggaaaatggagtcagtgaggggcgggcagggaggttcatgtctgtaagcccagcgctgtgggaggccaaggcaggaggactgcttgaagtcaagagttcacgaccagcctgcgcaacatcaagtgagaccccatctctacaaaaaaatttaaaaatcagccagatgcggtgacacatgcctatagtcttagctacttgggaggcttaggcatgaggatcacttgggcccaagaggtcagggctgcagtgagttgtaatcgtgccactgcactccagcctgggcaataaagcaagacactatatcaaaaaaaaaagaaaaagaaaaaagtcaatggagaggtgattcaaaaagtcaagttcaacttcctatgcccaaagatcagtggggtgcacatgaaatcggtagcgtccatgaaaatattacataaggtcccgtgtgtgaaggagagagagcagaaacaaaagagcaggctctaatgaaagcagattccagagatgacgaacagagattccttctagagcacttacgtcacctggggtgctttgtgtattctctttttaaaaaattgatctataattcacatgccataaaattcatccttttgaagtgtacgttggttacggcccttttctcttcacaggtgttctctttaccaaacccactattcctgctctgtgaagtctgtatattttaaaagtaaatatacatgagattgcttgagatcatgtagaaaccactaccaggtgtatctagctattttgaactcttcgacggctattttttacattgtacattgtcaaacactgaaacctttttcaaagagatatgtggtaggtttctccataattctctaggtaacaatgagggttctggttttcttaccttgtgagttctggctatgaaaactgtattttctgtaaaatttgacttgatacacaaaatttactcagctatttgcataagtttgatctgcagaataagcaatataaaggaaatgaatacttcacatttgtatcattgctttcaagattccagaacttttttttttttccgagacagagtctcactctgtcgcccaggctggagtgcagtggcgccgtctcagctcactgcaagctctacctcccgggttcacgccattctcctgcctcagcctcccgagtagctgggactacaggcgctcaccaccatacccggctaattttttgtatttttagtagagatggggtttcaccgtgttagccaggatggtctcgatctcctgacctcgtgatccgcccgcctcagcctcccaaagtgctgggattacaggcatgagccaccatgcccagccaaagattccagaacttttacaactttatttttttttagtttcctgttgtttccagaattacctttagttatttgtcatgcaaataaaactttccctgtgaaatatttggtatttttttaaataactgattccccagtaacaatagaaaatagatttctatgaaaaaggcagacttgtatttattaatgctgaagctgatgatttaatcacctcatttaatcttattttttacttttattttagcttcaggtgtacatgtgcaggtttttatataggtaaaatcacgtcactggggttttttgtacagattgtgtcacccaggtactaagcctagtatccaatagttattttttctgatcctttccctcctcccaccctcaagtaggccctagtgtctgttgtttctctgtgtgtgtccatgtcttccatcatttagctcccacttgtaagtgatagcatgtggtatttggttttctgttcctgcgtggttttctaagtataatgatctccagcttcacccatgttcctgcaaaggacattgtcttattctttttatggctgcatactattccatggtgtatatgtaccacattttctttctctcatctgtcattgttgggcatttaggttgattccatgtctttgctataatgaatagtgctgcagtgaacatatgcatgcatgtgtctttatggtaggatgatttacattcctttgggtatatacccagtaagggattgctgggtcgaatggtagttctgtttttagctcttggaggaatcaccacactgctttccaccatagttggaaaatatttacatttccagcaacagtgtataagtgtttccttttctccataacctcgccagcatctgttcttttttgactttttattaatagccattctgactggtgtaagatggtatctcattgtggttttgatttgcatttctctaatgattagtgatattgagcttttttgcatatgcttgttggccatacatacgtcatcttttgaaaagtatgtcttctgttcatgtcttttgcccactttttaatggggttgtttttttttccgtaaacttgtgaaagttccttatagatgctggatatgagacctttgtctgatgtatagtttgcaaatattttctcccattctgtagggtatctgtttactctgttgacagtttcttttgctgtgcagatgctcttaagtttaattacatcccatctgtcaattttagcttttgtttcaattgcttttagcatcttcatcatgaaatccttgctagttcctgtgtccagaatggtgttacctaggttgtcctctagggttttatagttttgggttttacatttaagtctttaatctatcttgagttgatttttatatatggtgtaagcaaggggtccagtttcaatcttctccatatggctagccagttctcccaggaccacttattgaatagggagtcctttcccaattgcttgtttttgtcagctttgtcgaagatcagatagtggtaggtgtgtggccttatttctgggccttatttctctattctgtttcactggtctatgtgtctgtttttgtaccagtaccactctgttttgattaccgtagccctgtagtatagtttaaagtcaggtaacgtgatgcttccagccttgttctttttgcttaggattgccttggcctttggggctctttttttgatccatatgcattttaaaatagttttttctagttctgtgaagaatttcattggtagtttggtaggaataacattgaatctgtaaattgctttgggcagtatagccattttaatgatattggttcttcctatccatgagcatggaatgtttttccatttgtttatgtcatctctgatttccttgagtggtgttttgaattaaaatttcagagatctttcacctccctggttagctgtattcctaagtattttgttctttttgaattacctcattttaaatgattttttaagccctcaatatttaaatgagcatccctaggattctctttttttaacttttaagttaaaggtacaagtgcaggtttgttacatagttaaacttgtattatgggggtttgttgtacagattatttcatcacccaggtattaaacctagtacccctaagttatttttcctgatcttctccctcctcccaccctaggcttctcagttaataacagtagtcataccacacatatataatacttcagtctccaaagcattttcacatacatggccttctgatctttaacactggacattatttattaatactttgcttattccaaaaagctttagacgtactaaaacttactattaatactttgcttatttcaaaatgctttagacttactaaaacttactgaaggtataattatagagttaagatatgaaaattaaaatttaaaacttaaaaactaaatagaaaacggaggcatgtattccagaaaccttggctgatatatttatagtgatggtacattaaagttaactctgagtttctggcttaatttagtttgaccatcaaggcctagcctactagactcagattctgaaggctttgggtctggccccttcccagccataactcctaggaggagtggcctatgtagagctgggggaagaggccaactcaccacaatgcttactcttgtctccaagcaaagctagagaaatcataacatttaatggtgcacatatttcaggagataagatgtttattcatctcatttggggttatacaccaatgaaactctgcagacttgagctccaaatttctgtttatttgaatttgtttacatgctccaaaatatagactgtttcatgagttctagagtcctaaatttttttaaatgggaaagactttagaactcctgtatctattgtaagctatgaattctccttttgtatgtgaattattctgaactctgccatttggggaaaaaaaagtttatttaaatgattgacattttgtattacttgcctttttcttaataaaagatattgtaaaattattttagctgaaatatcaaagtttggcatagttcagtcagttcagtttactaatgtcattatgcaacagttaagaaatcagacataaaagcataccaagcacaaattgattatacaagacatgtaccacctgccaacatgttagattgtcatagagttttagacttggaaggaatttttaaagatctgtaaactttcaaaaataaactggcagtattcttacttttaagcatgttctcctaaaagttttaaacaacagtaatggtcagcattgaaaaaagtcaagtatcatggatcatctataatttgcaagctttaatttattctttgaacagctttctttacaggaaacattggatgtttaaatactatgatgtcttacattcgtatgactattaatccctaatattttttgcatgttcactgtaaaaatttcaaggaagacaaatgaaatagagcaaaaaggtaaaattccctcttcatacaaactccacacttgatccactgccttcaagtgtaaagactacttgaaggtaaataaccactgttcacagttcattgtgtattctccagccctttctgtaagtaccaataaatagctattttctaaaattgatattactatacatactttttgcaatttgtgtccttattttaatatcatatcatgggtatcttttcatattaatacatataagcctatgttattgatttttttttagtgcagagtattctgtacagtggatgtaccattatttatttaggtacttccctactgagggatgtttagattgcctctagttttctaacattacaaataatactttagaattttggttcaagatggcagactgagcacatgagcttttcttccctttctccaaagattccttcaaaatgatactaaagcgatttaactaaaagatgtgacctaaaaccactaagactggagtgggggcatcagtgagcaaatatcttaacagatttttggaagacagaaagcagatgggaggatgttcactagcagagcagaggaaatcacagcccaggtgtgcagagggggtctgggatgagaaggggctgacctgtgagatgaagccccaagaggctctgagcctggaagacagcaggtaaaagggaggggagaaggggagaatgtggctgaaaatggggaaagaagtgaaaaaacctgtctgtggaacagacacccccactcccagcacacacacacattcagaatgctggcattgcctcctcgtccaaatacggaaaggaactaggacatggatgagaggtgggtgctgcaagacttctgtcttcattgtggaattggagaaagggcagcttgctgactggtaccccactctctgactctgtagaacttagccttttaacaaactctcacaacgtgcacagggttctcaggaaaccttcacattgcttttgtcttgaatgccaatggataactgaagataacatgaatgggtgaccaaggatcactagacattttcttaagcctatagcatgaaagataaggcccaagataaataactggaaaagttatttctggaagaaactgagcaaattcttggagaagaaaacttaaaggttctctaacaagtactgcttccatgaatatcctaatatgtatatcttttcatacttatataaataattctgtaggatagactcttggcagaagaatttgtaggtcaaatggaatgcacacttaaaattctggaaaataaagcaaaatttctctccaaagtcgtgccaatttacactcccaccagaagcacatgaaataattctttcttcacaccgttaccaaaactaaatattataagtgtacttaattcttactagatcttttttatttgcattttcctgaccactaatttttattgttctttatactctatgactttgacatttttaaattgcacttgtagttttcttattgattttaagaactcatatacataatcagtaataaccatttttggtgatgtctatctaaaatattagcctttatcttacatttcaactctgcttaaattatctattactctgtggtgaaaaattttcatctttttttattatactttaagtcctggggtacatgtgcagaaagtgcaggtttgttacacaggtatacacaattctgtcctttttttttgtggctgttggttttctgacagatacctttcaccaaaataaggatttttctttctataactagcttttaagaatttttattaaaacttgcccgttttgtttagttttcttctgaatgtctgatgatcaatccttagttgtcagtttatatttataaagataatggatagttgcttattctaggtacgttcagttgctttcctccacaattactttcatctgtttttgcaacagtccttttctccaaatggagcagagcccagtatgctgccaggctgcagtcaggcaggtttcctctgagtgtgcgtgggcaggggtcagacaggcagacagatacaaatcatcctctcttagaggcatatgaggattcagtaggataaacacgaattgcctagcatgataatgaatttaatacatattttccctgctttatctcaagactccaatatgtatcagtgactgcttaacaaacctgtttagtttgccttgcaatttccttgcaatgacaagaaacaggcttctcttcagctccactgccaaggaagcctccaggattatgccacttcgggtgtacctttttttttattattatactttaagttctagggtacatgtgcacagtgtgcaggtttgttacatatgtatacctgtgccatgttggtttgctgcacccattaactcgtcatttacattaggtatttctcctaatgctatccctcccctatcccccaccccatgacaggccccggtgtgtgatgttccctgccctgtgtccaagtgttctcattgttcaattcccacctatgagtaagaacatgcggtgtttggttttctgtcctggcaatagtttgctcagaatgatggtttccagcttcatccatgtccctacaaaggacatgaactcatccttttttatggctgcatagtattccatggtgtatatgtgccacattttctttttttgtttgtttttttttagatttaaattttacatatatgtatatatatactttaagttctagggtacatgtgcacaacgtgcaggtttgttacatatgtatacatgtgccatgttggtgtgctgcacccattaacttgtcatttacattaggtatatctcctaatgctatccctcccccatccccctgccacacaacacgccccggtgtgatgttccccatcctgtgtccaagtgttctcattgttcatttcccccctatgagtgagaacatgcggtgtttggttttctgtccttgcaatagtttgctcagaatgctggtttccagcttcatccatgtccctacaaaggacatgaactcatcctttttttatggctgcatagtattccatggtgtatatgtgccacattttcttaatccagtctatcagtgatggacatttgggttggttggtaccaagtctttgctattgtgaatagtgccgcaataaacatacgtgtgcatgtgtctttatagcagcatgatttataatcttttgggtatatacccagtaatggaatggctgggtctctagatccttgaggaattgccacactgtcttccacaatggttgaactaatttacagtcccaccaacagtgtaaaagtgttcctatttctccacatcctctccagcacctgtagttcctgactttttaatgattgccattctaactggtgtgagatggtatctcattgtggttttgatttgcatttctctgatggccagtgatggtgagcattttttcatgtgtctgttggctgcataaatgttttcttttgagaagtgtctgttcatatccttcgcccactttttgatggagttgtttgattttttcttggaaatttgtttaagttctttgtagattctggatattagccctttgtcagatggatagattggaaaaattttttcccattctgtaggttgcctgttcactctgatggtagtttgttttgctgtgcagaagctcttgagttcaattagatcccatttgtcaattttggcttttgttgccattgcttttggtgttttagactgaagcccttgcccatgcctgtgtcctgaattgtattgcctaggttttcttctagggtttttatggttttaggtctaacatttaagtcttgaatccatcttgaattaatttttgtataaggtgtaaggaagggatccagtttcagctttctacatatggctagccagttttcccagcaccatttattaaatagggaatcctttccccacttcttgtttttgttaggtttgtcagagatcagatggttgtagatatgtggtgttatttctgagggctctgttctgatccattggtttatatctctgttttggtaccagtaccatgcttgttttggttactgtagccttgtagtatagtttgaagtcaggtggcttgatgcctccagctttgttcttttggcttaggattgtcttggcaatgcgggctcttttttggttccatatgaactttaaagtagttttttccaattctgtgaagaaagtcattggtagcttaatggggatggcattgaatctataaattaccttgggcagtatggccattttcacaatattgattcttcctatccatgagcatggaatgtttttccatttgtttgtgtcttcttttatttttgttgagcagtggtttgtagttcttcttgaagaggtccttcacatcccttgtaagttggattcctaggtattttattctctttgaagcaattgtgaatgggagttcactcatgatttggctctctgtttgtctgttgctggtgtataggaatgcttgtgatttttgcaccttgattttgtatcctaagactttgctgaagttgtttatcagcttaaggagatttggggctgagacgatggggttttctaaatatgcaatcatgtcatctgcaaacagggacaatttgacttcctcttttcctaattgaatacccttttatttctttctctggcctgattgccctggccagaacttccaacactatgttgaataggagtggtgagagagggcatccctgtcttgtgccagttttcgaaggaaatgcttccagtttttgcccattcagtatgatattggctgtgggtttgtcatgaatagctcttattattttgagatacattccatcagtacctagtttattgagagtttttagcatgaagtgctgttgaattttgtcaaaggccttttctgcatctattgagataatcatgtggtttttgtctttggttctgtttatgtgacggattatgtttattgatttgcgtatgttgaaccagccttggatcccagggatgaagccaacttgatcttagaggataagctttttgatgtgttgctggattcggtttgcaagtattttattgaggatttttgcatcaatgttcatcagggatattggtctaaaattctctttttttgttgtgtctctgccaggctttggtatcagaatgatgctggcctcataaaatgagttaaggaatattccctctctttctattgattggaatagtttcagaaggaatggtaccagctcctctttgtacctctggtagaattcggctgtgaatccgcctggtctgggactttttctggttggcaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggatcggtggtgatatcccctctatcattttttattgcgtctatttgattcttctctcttttcttctttattagtcttgctaacgatctaacaattttatcagtcttttcagaaaaccagctcctggattcattgatttttttgaagggttttttgtgtctctatctccttcagttctgctttgatcttagttatttcttgccttctgttagcttttgaatttgtttgctcttgcttctctagttcttttaattgtgatgttagggtgtcaattttagatctttcctgctttctcttgtgggcatttagtgctataaatttccttctgcacactgctttaaatgtgtcccagagattctggtacattgtgtctttgttctcattggtttcaaagaacatctttatttctgtcttcatttcgttatgtacccagtagtcatttcaggagcaggttgttcagagagtctcgctctgtcgcccaggctagagtgcagtggcaagatctcggctcactgcaaggtccgcctcccaggttcacaccattctcctgcctcagcctcccgagtagctgggactacaggcgcccaccaccacggctggccatatacttttcttcttagacatcaaaagcctacctgatttaactggcacagttgtgtgttcttatggcttttgcacccaactgtctgtcggagtagttgcctcttcccagaagaacaaaaagagaaagaaaagtagacatgcttcttctgtgcgtctcctgtgctgacctcattctattcagagaatggtttctctaggggtataaatgtgtgatgatgtgtttatgcctctccaccttactcccccagccctaggctgcatccagtggtctaagtggcattcctctgctcttgctcttatgtggtctccagttcttggccttgtcttccatttacagtccagctctgcccattgaaattggtctttgcagagctcttatttccagctgggatgctcttggacaagttccttaacttttctgagattcggtttccccataggcaaaataggaaaacaattacaatgtcatagaactattacctttaaatgagaaaatgtaggtaaaataccctgcatgtcaaccctattagttcccatatctccctggatcagtgcttttcaccctggctgcacattgcactcatgggaggcatgctgtgtgaggcatgtttgaactatgctgatgcctgagtcccacctgcatgtttaattggtcaggggcacagcctgacagcctggacttcaggatttttttttaaactttaaaggtgattgcaatgtcctttcaggataaaaggccttttccctatgtcagtaggtgtcaactagggactattctgcacccgctccccatacatttggcaatggctggaggcatttcgattgttacagtgagggcagagaaggggggaggcgggtgctgctggcatctgtcgatagaggccagggatgctgctgaaccttccacagtgcacagggcggctcccacagtgaagaattattcagctctaaacctcagtggtgctgaagtaagaaaccctggcctgtttgatcactaagatccctttcagtgctgaagttttgtaggccacttatttcagaatgatatttttaaaataacaataaatatctaaggttttctttgaatgaccgttttatgtaccattaagttcacattcatcagctcactctgaatccttagcttccaatccaatccccctcctttggtttactttccagatttcactcagttcttggtagtgggcccctagattgcttatctctgaacagctgtgaggcagccccaacaacagaagtaccatcttaaaatgcccttttatagccagccctgtggtgtttggagtcctttcttgctttcttaatacatggcagaagaataaaggacagaaaaaaaagaaaagcaaagaaagtcagtttttctttggattctcatagaactctgatcatctctccagctcggtacttaaatatattttactgtagtttatctgtttacatgtctgtgctcttcccggtgaggccgtgcaatccttgaagacaaacaggccagccttagacagtcttctctggagtacacaccatgagccaggaactgtgctcagtggtgtggatacagaaataaaggtcgtgctggctctcctgaggcccatgcatggtgtgcagcccgtgtgggggttctgtgctcagacatcttagcccctcttgatcatgagacctcgctcgtggtactggagtcatattactactcactagatgcttggaatcctgggtctcccacctccttcatctaaccctcacaacactcacacaaggtgggaactaatgtcatcatctgcattttatagttgagggacctgcctgtggtaaacaatttgtgaggggtggagtcaggacttgaacctgggcacaggcctcacttatgaccttccctgcatgtttatgaccatggccatttgcaagaaaaatatggcagggtggggtggtatttgtgtcttctcacttcccagccactggaagaaagacatgttccactgaattccttgcagccatcttgcaccctcctcactgttccatccctgtccccactgctacctcaaacttgattacaatcatgcatcccatgctctctttgggaatccttgggctaaatctccatagttattatcttagtcactagacttgcaccatcttgcctcagcagaccttctggaactagcttttaaaagagtatccagctcttaaaaagagtagaacattttagagaaataaaacatcaagtgtgtgttttttctttttttattgtggtaaaatatatataaacataacatttatcattttaatgatgttaagtgtataattcagtggcattaagtacattcactgctatcaccacgatccattttcagaatttttttttgagacggagtctcgctgtgtcgcccaggttggagtgcggtggcacgatctcagctcactgcaacctctgcctcccgggttcaagcgattctcctgcctcagcctcttaagtagatgggactacaggcatgcaccaccatgcctggctaatttttgtatttttagtagagacagggttttaccatgttggccaggatggtctcaatctcttgacctcgtgatctgcccacctcggcctcccaaagtgctgggattacaggtgtgagctactgcgcccagcctcagaatattttcttatcccaaaagctgtactcagtaaacaatagcccccttctttccccgtcctccaagcccctggtaacttcaactctctgcctcatgcactgacctattctaggaacctcatacaagtagaatcacacagtatctgtccttttgtgtctggcttatttcacttagcataatgttttcaagattcatccctgtggtaatatgcaccagaatttcatttcttttttatgtatatgccacattttgtttatccattcatctgttgatgggcacctgggctgtttctctcttttggttattgtgaataatgcgctatgaacattggcatacaactacctgtttgagtcactacttccaattcttttgggtatatacctaggagtggaattgatgagtcatatggtaactctatatttaactttttgagaaactgccaaactgctgtctacagcaactgccccattttatcttccaaccagagtttcaatgtctccacattctcgccaacacttcaagtgtgtttttgaaagagtatttaagcatgtgatataataggcaccaatggtcagctctgaggcatcaggacaagatgctgcgctgggctttgttacctgctgcaggtcatggcagcccctggagacgattaagtcacaaacaactcaaagtgatatcctgactcttggctgaatgttcctcgtcaatgctggtagatgaggaaagtgatcattgagtatttgttttttatttggactcagttcttgccttttcttcaccaaaagcttttatgactcttgtccagaaccaaatattcacaaaacaaagattccatgccaaagagactgtgccctcttgctgtgatttggaaagatgctgttgtttgttttagcactcctggacttacttttggattacatactttccacatggtgtctgacagcgcacctccctttgatttaggacagctctgatgtccttgcatctgtttacagggactttcttttcactttcagagtcctttgccttgaaaagctttcagatatgctggaacgaaaggaaatcaactctgccccacccccttctgctgattgtttcacattttctgctttgtattgatagttagcacctagctaccctggaaatgtgagactgagttttcctgtttgtacatggatttgtctttcattttctggggaaatagttaagctgtggtttgtttttgcttttaattgtatcgtctgtctcagaaatatgcaaaatgcccacacctgttttcctacacttaatgtgatactttcctcaaatgcaggaaacagttgctgagctggctgagtcttgaatttttatggaagtgatttgacaccgctatccttgcatgaggaataacattgtctcctagcccactctaggcagcagcgcctaaggacagcatcttcagcagggctgttaatcgctcccaggtctcctatctggattaggataatagctgagaatccattatctgcaagtccaatgtggttaacactgtccctagatccgcctattccctaacccacttggaagtgcatttaaatcttccctgtttgaatcaaagtcttgcttttttgtgatatgttagatcactgagctaccacattagggaactaatacaagctaagccccaagaagagatatctaaggtttaaacaacgtttaataaatatagttgacttaatgaaagagaagtgactcctgagaaaaacagtaatcttgaagatttcttaaccaacagctggggatgacccaccctttgcttctccatggttactgctctcactgggagcctctcttccttcctcgtgagcatcagagcttcagaaatgtgaaacctgccttctaagattgccctcttctctcttcaggccttactttcccatggaagaagttgagcaccctttccccttttttattaagcagaactctaggcacattgtgctcttcttctaaaccttgaagtcttgcagataagtcactgaaggggtggtctttgaagataagcctcctttctccctctcatcatgaaccgcctttattagctttgctctggctgttttagcatcaacagctttaagaataacttttggcatctcctgactctaccctactctgtccccaagccagacactattctctgaattagaaaccatataaatgtcagcatgggaaagactcactccttctgtctgaattctgaatcaatattcatgttcttccttggaaaatgtactttcacatagccccaccctttaactttctttgtggccttatagtcacgcctatatttgttatgctttgggggcagaatttgtctcattgatcaatatttatttttccctttattatctagtgtttagtgtgaatcaggactgattttctttctttgattaaagaaaacattgctctttgtctgaattgatattcctgcaagataattaaacatttcaatggatatctgtaagcacctactgtgtacaatatattatgaagagaaagagttgaacgatacatggccccttccctgaaaggcatttactgtccatttggaaatcctttgatgactttgaaaagagacccagtgctatgggagtgcaaaggatggagaaattaactctaataggataatcagaggaggcacctgggggaggtggtatttaaactgggcttgtagagcaggggctggcaaccttttttttggaaagaccatatagtaaatatcttgggctttgcaggccatttggcctctgttacagctactcagctgcacagtgagaaagcagcatagacaatatgtgaatgaatgggggtgcctatgctccaataaaatacgatataccaaaaaagccagccgccaagtttagccctcatgctgtggtttgcccacccttgttttggtggatggataggcttttctcagaagaaatagggaaagagcatttcaatctgaagaagcagcacaagctaaggtacagagaaggaagaatgtgaggcatgttctggacttagtcacttatgaaataagtgagggtgaccttgacatttgagactgcaaatacagggtatagctaggcctgtttcatcctgaaccacatcctttgtattaaatctgaagatgctcggctggagaagagttgtgacagggtcctgcctctgctctgcagacagtttggggcagttgtagaggaggagggggagcggctgctgtaaaaaggcctggcctataggaagagtctgaggcaggggaagtgactaataacaaggatactgctatgtcagtgggctctgtgattccaaacagtaaatttgaccgtgttagaaaaccagagtttttgcgtgtgtttttaatcagtgactgtaggttgagcaccttatgatagaagaacgtaatacacaccacagtattgctacatcagggagtgataaactgcacttggaaacttgagatgatctggagcaaatcagagtagaaaagacggataaataattttgggagttggaaatttaggtaatcagtcctctttaaaaagaggggagtggttgcatttgagataagctaaatcccttcccttgtctctaaagcagtacttttgaaacctagtccagcctttcctgtctttcctgttttgttggtaagttctgggaacaccaaggttctctaagccttctcccatacaaaggtcccaatccaaacagcaggttctcagcaggcagcatagatcctgtcctacatgaatgctttcagttgaattccttgatttttaattatccctaacaaatcacatatttgccaagtttttagaattgctgcgagaagaccaatattaacctgtaagataatttctgttggtagggtaaaaatttgttgatcagagaaaaaggatttaatcaactgcattaagatttcttgtaaataaatactccacatcattgctaggtcctccttaacttacaaaatcgtgcatggctaggactcacttggaattttaagaaaaatttgaattatcagtttcactggccaaaggacccaaagtactgtctcaaacatttcagtatgagcagaattgtgcaagttaagagttctactctcagccacgcagctttctggctctatagccttcagtcagttacctgacctctccgtatgtcattttctttacctgtaagatgaattgacaataatatttatctcatagggttattgggaaggttaaataaggtaaaacaggtaaagcatctagcacaatgactggcacaaaatacttattcaataaacatcagatgtcattactagtaattttttttttttttttttttgagatggaatctcactctgttgctcaggctggagtgcagtgccatgatctcagctcactgcaacctcttcctcccaggttcaagcaattctcctgtcccagcctcctgagtagctggattacaggcatgtgccaccatgcccagttaatttttgtattttagtagagacagtgtcaccatgtgggctagggtggtcttgaacccctgacctcaagtgatccacctgccttggcctcccaaagtgctgggattacaggcatgagccactgctcccggccctactatggtattttaattgttgctactgttatacaaattagtccaggattatatggttagagatccacataattgtgctttgagactttgtctagacaataaatacctttccaaaagcaaaagacaatttttttctagacttatcaagccaacaatcagtatcaaaagtttacgtggcacactgggcgtggtggctcatgcctgtaattccagcactttgggaggccaaggcaggtggatcacctgaggtcaggcgttccagaccagcctggccaacatggggaaatcctatctccactaaaaatacaaaaattatcagagtgtggtggcgagcctataatcccagctactcgggaggctggggcggcagaatcgattgaaccgggggggtggaggttgcagtgagccaagatggttccacttaactctagcctgggcaaaagagtgaaacttcgtctcaaaaaaaaaaaaaaaaaagttttacatggcacatgcctttataactaactgatagtgaactaagatcaagcaccgtttgagttgtatccagtaaatatggtgtcccctaactcagctcattggcttgaggtggtaccaagatgttcatgggggcaaacggaagttgatcaacacttgtatttcagacctaggcaagtatgaggattgggctattagatgttcctcttttaatatgaatactgacttactattctctgatgtgttggtctttaaaatgttcagctgtgcctcagagaacagtgaaatttctgctgtcagcatgtgagggtcatgggcacggtctctcagtaccattcagcatggggacccttggagcccctgtgaaatccgaccccccctggaaaggatgaagacatagttcaacccaaggtctttatggacctgctgaattcattacaattaagtaagttaaactttcatcacagactttatcccctcttctcaaagcacaagtgaaaaagagatacctgtttaagtgccaaaagcctattgtctggccagagccattggctggcttagcacttacttatttgttggataagctttttattgaaatgctaagtataaatacacaggaaaagttctctattcaaaactataagtacagcttgatgaattttcacaaagtgaacacagtcacgtcactagtactcagatgaagaaatagaacttgatcagctcccagaagccccttccagtgtcccctctctgtcactaacctccccaccgcagaaagaaccactaccgtgattgttcacaccatacattagtttttgtctgtttttagaaaaaccttatataaatggaataatacagcatatactgttttgtatctggctttttttttttttttctcaacatttttaacatttaccttggagtagagtataaaatgagaaggtagatttcttcctaatgtttagccaattttacaaaccaatttgttgagtggttcatttatttaacattggaatgtgtagaatgtgctaagtcacatacttaccatttattgtattccatttatctgtcaaataatttctgtaccacacagagtattttggttatcatagctttaaaatgtgatttagtatctggcatggcaattcttccctcttttgctactttctttctttctttctttctttctttctttctttctttctttctttctttcttcttcttcttctttttttttttttttttttgagtcgaggtctcactctttgcccagtctggagtgcagtggtgcaatcatggctcactgcagcctcaacccccctgggctcaagagatcctcctacctcagcctcccaagtagcgggaactacagactcacaccaccatgcctggccgatttttgtattttttgtagagacagggtttcaccatattggccaggctggcctcgaactcctggactatagtaatctgcctaccttgacctcccaaagtgctaggattacaggtgtgagccatcgcacccagccttgcttcttttcaataacaattttcagacagtctagcattattccaggtgaatttttgaaaccattttgtcatatgtaaggaaaaaaaaaatcctatgggtgtttgcacgcaattatgttaaattcattcaataaacatgtactgagtccttactgtgtgccgggtggaattctgggtactgggaatactcagaaaagggcacaccagccctgatggcatttacaaaattctaccggggaaactggagacgaaagaacaaaaaggtaatttcagatgatgagacatgctataaaaaataaaacaggggaagaggagaatgagtgctggctggaagagcaggctgctatttgagttaggttgtcaatgtcttaaggaatgtgatccttgaattccaacctgattcatgcccagagtgtattagatctataaattcatttgggaggagtagacatggttaaaatgttcagtctggccaggctcagtggcttacacctgtaatcccagcactttgggaggccgagccgaacggcctacttgaggtcaggagtttgagaacaacctggccaacaggtgaaaccccatctgtactaaaaatacaaaaatttagctgggcatggtgggaggtgcccatagtcccagctactcaggaggttgaggcatgagaatcacttgaacccaggaggcaaggttgcagtgagccaagatcacaccactgcactctagcctggacgacagagcaagactccatctcaaaacagcaacaaaaccattcagtctaagaacatagcatttattaccgtttattcaaatagcttacatctgccagtgaagttttgttattttccatataaattctctgcattccttgtaaagattcatcataggtatttaattgcattttgctgtggtatgatgatgatgacaaagaatggaatctgttcctttttatctctaaaattcttatcaatatacagaaaagttatgggtttttttatatttacctctatctggtaatttcgttgcgcttttataaattctgagtaatttgagttgattctcatcgttttctagtgatataatcataccatatagaaataattataatattgcctcctcctttccaatagtaattactctgaatagcagacatccttaacctatctctgattttaatgtgaatgctcctaatttttactagcaaggaaaatggatgtatgctcaataaatattttaattgaatatatgattacatgctcatcattggggtaagaaagtctatttctaatcttgtaatctttttttttttttaccaggatgagttttaaatgacattttggcacctacttacgttattttttctttaaagttttctatattatccttgaattcctggattataccctgtttcatcttgctgaatggtttttttaatgttctgttgaattcaatttgctaggaccttatttgggatttttaaaatctgtattccgaagtgagattggcctattgttttcattttgtgctacctctctgaggtggaggttaggttagtgttccaatttttatgtgctctggaaaagcttatataataatctgttccttcagatttttataaaaactcaccaataaaaaacatctggcactagaatatttttggaagaaattactgctaacttgtaacaattcttctatggctgtgagtctactatgttttcttgttcatcttaaatcaagctggtaattttttaatgtatctttttcatggagaatttcaaatgtagtatagaattacatatcaaattcacttttaatttcagcatcatctgatatattctcttatttgggctttattgcttttttattaaatttgcttattttcaaaaatgtcttggagaccagctctcaggttcttatgtgtgtttttctttcttgaattcacatacttctgttttatgatttctaccttggtttcctctttttaaaaaaaaaagaaataagagtatttaaattgcataaattcaatgtgtgacacttctgtttttgctgttttctcagtggttcttaaatgttttcatctcaggacccttttctcctctttaaaactgaagaccccagagagcttttgttcatatgaatttattcgttaatatttacagtattcacattttaaactgaaatttgagaattttatattactttgctttcaaataacaataataaactcactatataatacagtaacagtttttttaaagtaactatttcccagagcaaaaacattttgagaagagtggcatcattttacaatttgcaaatactgtatcttttaatgtctggcctaatagaagacagctggattctcatatctgcttctccaatctattgtgatagattatttggctaaagtatatgaagaaaatctggtttcacataaatatgtagttggaaaatagagaggtagtttagtggtcttttcagatcattgtgaatcttctcctttgatactataccaaactagaaaagtggtagtttcttaaaggttagttgcaatgggaaatctgaaaccacatcaataaacttgtcatgttctttatactcatgagtaagagaaaaaaaggcaaatagcatcttagagttgttatggaaataggtttaatctcaaagatcccctgagaggatcttaaggaccatactttcagatatacttttccaagtaaatggaaatatatccatttttttaaactttttattttcaagtaatgttaaatttacagaagagttgcagagagaatgcagagttcccatgtactcttaacccagcttcccctaataagaaatttttaaaactttatggtaaaatatatataacataaaatttaccattttaaccattttaaatgtacagttcagtggcattaagcacattcacattattgtacaaccatcaacagcacccatccatagaactttcttcatcttccaaaactgaaactctatacccatgatgtgtaagttggattcacttattaacccaaactacttgaggcatctgttgagatttacatgcttaactggttgcatttgtgctgttaatacctgattgtattgctttggagagtgtagtctgcatgattttgagggctgaggtgagaaagaaactgtttctctctctgtctactgaatcagggctatacagtttataccagacaaaaaaggacagctgttccctccacataggagcacctttgttttgagatggccagagcactgcctcttcatcacttcatcagtctctgtcagttgatataaaccatgaaatcagaacacatgggatagtgagagtaatgacatgacgtttcacccacaaacaccatattgctaagcttgggttataaggacaaaggaagaggaggagtccctagacccattcttgggggaaggggaagtcagtagtgatggaggacatggtgcactctgttgttccaatctctgtggggggaagcagtagcaagaaaactgaagatttacagccagataggaaatattttaggctttgcagtccctatggacactgtcacaactactcaactctcctatgcaaaagcagtgactgattccaataaaactttatttacaaaagcaggtggcaggccatatttggctcagagactgtgttttggtgaccgccacactaaatgaattcctggcaggggtccgaaaactggttaagacttaggaatatctcagtcaacactagttgaccatcttaaaggagagttctaccagcacgcagatgaacagtaaccaaggcaatggacagtcacatatcctgcctgttggctggtaccaaagcaggatatcacgcttccttccaacatttagttgataaaagtttcatagtcaactctgagcatgaggcaggtggcatctattaacccctagagaataaaaattaaactacagacttctcactagatgtccaccttctttaactgcttgttctttaaggactattgagtccacctcttaatgttgttaggttttgctgttttaaattttattctatatgaaaaattatgctataatttttagaagttatgggatatttgctgttaggaccaggaagctataaccagagcattattgcttcctcctgacagcactttctgtttttagaaaacaggcataagagaccgtgaaaaaccactaaaacggctgaactcacaagctaaccttaaaagccagcaccttggccaggcgccattgctcacaccggtaatcccagcactttggggggccaaggcgagtggatcacctgagccaggagtttgagaccagcctggccaacatggtgaaaccctgtctctactaaaaatacaaaaattagccaggagtggtggtgggcacctgtaatcccagttactcggaaggctgaggcaggagaattgcttgaacccgggagacggaggctgcagtgagctgagatcgtgccattacactccagtctgggcaacaagagtgaaactctgtctcaaaaaaaaaaaaaaaaacaaaccagcacctcagaaattcatctgtatcaaccattcatcaatcaaaaatatttgaatgcaaatatttggaaattactaatgcaaagtatgccaatatgcaaattaacctgtttgttcattttttctcatttattcattcattcacttattgagagtctgttatgagctaagtctgttattagccaagtctgttttaggctgcagttgtggcttcagttataatctcctgtaaatgtttgttttgttcacatgtgttcagatgtattctatgtaacagttgcctctaccttctattttaatgaaaaagctccttgagcacaaatctgtattttcccgtctcttcataattctccacagttcccaactgcatgctctgcatgcaataaagcatttagcacatgattttgatttattgactggtgggaagcctttacaagccagtcttctgtcttgagccccatccagaattcttctgttaatttttctatagttcccaaaggttacaaagaacattttcctttcagcctttaagagcttgtgtagaattagtcatcactgggacccagacttcaccctaaacatgagtgcatttacatgctccagtgaattaatcctgatgtcatattgtgaattgtgtcctaattttttaagagactccgtattccatttgattcataaaaatgaaaagtaaaatgctaatgtgtaaaactgttgttactccagttaatgaaatattttcccaacctttcataatcagttccagcctagatgagaagcttatttgcaaaaataatagatgaaaaagggaaattaaatcctctgtaattaaaaatagtaacattcttctattaggttccctgtttaatcatcttcattgttttgttttgtttttttcttttttgttgttgaggtttttttttgttttgtatctctgtgtgtgtgtgtgtgtgtgtgtgtgtgtgtgtgtctgtgacagagcaagagagagaagagagagaggtgcctgtaattttctaaaacctgtgtttgagggcaaaatgttaacatcttggaataatcaccccctgccagtgtttttttctttttcaattatttgcttactttgacattttcattccccactatgacagatgttccagaaccacgtgcatatggttctcctcctgggcaaggccatttccctgcctcctctccatcccggcccatgagataaagctcaggaacgccttttgtccatctttggctggcaggcaagagccagggatccccacactctgcaactgtatccataaggccctgtagagctcttcagtttacttcctcctcaatgagattctgaaagatggtttatctaaaatgtgaccaagatatactaataattctactggaaatttctacgaagtgtttttaaccctcaaaaagtcagaccaaggatggattttgaacctggtgtggcctctctgctctgggagccaccacctggttcctcggatgctcagtagctctgggcttccggaagcagcgtctgtgaaggggcaggggagagagtcccagacatggagcctcaagtcaggctctgaattctgtgtctgccactgagcagctctgatcttgagcattgttatttgaactctgtgactctcctttctcctcacatataaagtgaggataagaggaaggtagagaggatgaaaggagatcatgttgtataaagctgcctccatatacagaataagccttccccctcagtgctgtcataaaatcagtaacccacaaaggagagccaagttcctccaggcttcacgcctaaccagagaggtgtgtgggatagaaaaagacctacaccatcctcctagctctgtgctggatgagatttgtcacttggggcaagactgcgtgcatcacctcagtttctgcatccataaaatggaactgataccatcaccctcattgagatcatggggattgagaagatgtacacatgaaagtgccagcacctcttctggacaatggaagagattcctcgggtgttatttccctccagtttgggttctgagtccagaatcctttctggagcaacctgtttgggtgttcttccccgtccctgaacgtgagtggaggcttagagctgactttttcatgaggcaacctcttcaaccctgaacaggtcttgctcttcaaaagtccttgatatttaaccaaaatatgccgcttcaaacttcccactggtgatgcatgaaatagagtaaatgcccccaaactcttctccaattaagattttttatcccagtggaatcagattcaattaagcatcaaagtcaatctttggtggaaaaataagtcaaatttcagccagagtgatctttgcagaagggccatccttgcctttggctctggccctggagttgtattgaggttttgtgattaatgggtaattgcctgagccttacattttttaagatcttttggtggaactgtcctctttggtgttgctggctctttcttcggaatcacaaaagcccagaatccttgctgagaatctggggtccttgtggcatgcagctgcagctgccactccccacctcctgggatggtgcctgagtctgtacttctagatagtcacaaggtcgtctagcagagtaggagccaagagtcagtatacatgcctgactggggcgtggggacctgagatggcaaggaggaccgagtcttactgatactcactatggtagacagaataatggccccccaaagttgtccacagcctactcccgagaacctgtgaacatgttaagttacatggtgtattagtccatttcacactgctgataaagacatctcctagactgggcaatttacaaaagaaagaagtttaatgacttacagtttcatgtggttggggaggcctcacaatcatggcagaaggcaaggaggagcaagtcacatcttacatggatggcagcaggcaaaaaaaggttgtgcagggaaactcctccttataaaaccatcagatcttgtgagacttattcactgtcatgagaacagcatggcaaagacctgcccccatgattcaattacctcccacaaggtcccttccacaacatgtgagaattcaagatgagatttggatgggaatacagccaaaccatatcacatggcaaaggggaattaatgttacagatggaattaaggtcctaatgaagacccttgtgatggaaagattaccctggattatccaggtgagtccagtgtaaccacaagggtccttctaggtagaaggggcaggacgaagagttgagtcaggaagagatttgaagaggctgaactgcgggctttgcagatgaaggaaggggccacaaactaaggagtgcaagaaatacaactctagcagctggaaaggcaaggaaacaatttttcccctaaagcttccgtaaaggaacacagccctgccaactccttgattttagcccagcaaaatccatttcagacttctgacctccagaactgcaagataatacatttatgttgctttaagccactaagtgaatggtgatttgttacaacagcaaataggaaaagaatacactcaccttcctttatcatcaacacatcctgctactcaaggcagggacttcacctggctggagaccatgcctgttcaggtgttagctgatcgttaaggagcagcttgtctggacgggaaggagcacagacgttggatcgaggcagagctgagtgaggcagtgccatcactttctggcttcacagccttgctcagattgtttcatttctctgacctttatgctctaaagcaggaatcattacaggattaaactacagaatgtactcctggttgattacctggcatgcagtcagctctcaacacatggtctcttttagtaatgatgagttgaactgtgccttttcttccctcccctgggaagtgtttctctttttttagggtgtgagagagattgacattctctcccttgtctagcacaggactgccttgccctggggatccctagtgaaccattgctgggaggctcagatggactccaggcagctggacatggcgaatacatgagagattggcatagcgtatccccaggggaatgagaatgaaactagaatcaagattcccgaagatcaagccgtccaggtggaaacctcaagtagccaaacacagcagtgtggttgggctggaatgtttaacctctctgggagggataacaacattccagctgggacgttcaccaaaagtaacaagtaatcacatgggtgtgttctctatccaaatgaccagagcctccatctggctagcttcccatgtaattagtttaagagtaacaaaataccaggacattaatatatacaaaggagtgttccagaacatctaggcacagactgataaaggagacgtgggtgtatgtgcacgtgtacgttaaagatgagttaatttcaatgtttctattattctaaactgaactgctgctatgggtttcaagaattacatagcttatgaggtcatctggctggaactatgattccagagcatccctcaaaacacgagaggacttttttccccacttttatgttgttagatgccaaggtgatttagccagagtcaaagctgtactttatggcaggacatatattcttccactgtagattttttgtttttgttttgttttgttttttgttttgtttcattcaccgagttggaagatttagctctgcagtgtacagggagctaccagtaaactgtaggtcaggagctggccagggtgacctcagcttagccaccagagcccaactctcaagttgttcaactctgtgtctcctcctctgtgcttgatggagttaactaggagatctctgagttggagtgtcgctctgacctctgagggtacttaaagggaagcagcaggagaaagtggggaggcagagagtggcaccaaggtgctgcagatgacgtctgctggctgtgttcctggtaataagaagcgctgtcctctgaagggactcatgttccagggaagacaatttggggaaatgctgaccgaggtcatattttaatgtttaaagctagcttttaagtatttaaagaaacgatttacaagtcagtctcctgaaattacaattccataaaacttccaagtgggcaaagaataataacttaaggaagagcagtttcctaaacagatgagagtgaagtccaaattgcttttaaagggagataaaaaggtctcaaatttcttgctatggttctgaatgtttagtgataggttcgtttgaagatgaaatcaaccctgatgttagctcaataatttcaggatgtggggagggtggggggaaacctagcctatgggaaaggaaaatcaggaaaaccttttagtagacagacatttttcattgctatcaaaggatgtgtaaggccacaaaaacctcttagcaggaagcatcctggggtgatccatacattctttctggtgaggcagaaggaaaaggaggtccaagtctcatgatctgtctctttagatccagtagcagcaaggatcctaaattggtggataaagaaacaaagccaactgggcttggtggctcacacctgtaatcccagcactttgggaggccaaggtgggcagattgcttgagcccaggagttcaagaccagcttggtccacatgatgaaacctggtctgtacaaaaaatacaaaaattagccaggtgttgtagtgcacaccggtagtcccagctacttggaggctgaggtgagaggatggctttgagcccaggaggttgcagtgagccatgatctcaccacttgatatggtttggctgtgtctccacccaaatctcaccttgaattgtagctcccataattcccatgggttgtaggagagacccagtgggagataattgaatcatggaggcggtttcccctatgctgttctcatggtaatgaacaagtctcccgagatttgatgattttctaaggggtttcgcctttcacttggctcctactctctcgcctgccaccatgtaagacatccctttgctcttccttcatctcctgccatgattgtgaggcttccccagctatgtggaactatgagtccattaagcctgtttcctttataaattacccagtctcacatctgtctttattagcagcatgagaacagaatcatataccactgcactcaggcctggatgacagagtgagaccctgtctcaaaaaaaaaaaagaaagaaagaaagaaagaaaagccagtgtcaaggttggaggttgagcagaggtgagcataaagatctcctctcagatgaaggtggaccctttggtggaaaccatgtgagaaatggtcttggtcagatcctctatttggaaaaaccatgagagatggaatggatttccatctatgttctggtggctttatccttcttgtaatgtcatggttggttcatctgattcagaatacttggatttctcttctttcagtttctttctctttataatctattttatcccaaaatatagatttggacctggttagcatttttcacttgcctctaagatctgctgtctctgatgacttttaataaaggtctggcatctttcaagtatgactctgggtcaacatattttcttttaacatggttaagcttttgcaaggattatacattttccttccagttgtgcagcaagttgcctggcaatttaacttttcatttctgtgtatagtttaattgaaatttttattgaaataattgggaattcatatgcaattgtaagaaataatgtgttatttcagattttaactgagtgaaaaattctgcttccaaacaaaagaactgttaaaaacaagaaatccagcgattgctgcccatattatgatgtcccaagaaaaagtacagataccaggaactgaactgaaattttcaggacatgctgttataactctgtgtagctttgtcaggagaagcctgaagtacaactctgagacagtccatagccccttgatagcactgaagaccaccacactagaccccacaggaccacagcaaaccacccagaacactcccctgtatccacctggagtcgtgtgcacctggccaccaggatggtcctaagtgcagcagcccacaggagatggagaggtgtgccgaggaaccagcagtgcatgtgatggccctggctctctcttaatttgaagtttgccttctgtgccccttgaattcacatctcattctgtctcctcacggccctctttccaaaacctcccacggaatacgcatatagcttaatgagctattacaaggggaagaactagaactctgctagtccccagaggcccttccacaggctgtgtcccaatctttgctccctctcttcctctcttgacttttagagaaatcatttccttgcatttctttataattgtataacccaagtgtgcatccctaggcattctggtttaacctggcccattttaaattaggtcctttaagcctctctaatctacagattctcccttctatccttttattgtatgtgtatgtgtgtgtgtgtttgtgtatgtatgagtgtgtgtgtatgtatgtgtgtgtgcaagttcagttcctgatacctataattttcttgagacgctgtaatatgggcagcaggcattagattttttgttaataatgtgtgtatatacacataaaatatttgtgtgtgtgcatgtgtgtgtgtgtgtgtgtgtgtgtgtgtgttacagcccagggtatttgactgtaacatttctcatagtggtgagttttgctgattgcagagccattctcccttagtgaagggacagatgatggtgaccactacagagacaggtaagaaggtagcctgagtcccaaccaacccagggagccacagcccctgcacactcaggaggcaggacggatgttgctttcttcttccttcacaagggagaagaataccttcagaatcagattcaaatcttgactcttcctcattgttagctctgtgaccttgggcaagttacttagcctgtctgagcctctgcttcccatctatacaatgaagctaataatgcccacccagagactttgtgaagattatataagacaataagtgtgtgttgggcaagttacttaatttatctgtaaaatgtaaatagcagaggtaaaatgattgtgataactaaatgagttaatacagataaagcatgcaggatgtgcctggggcacagagaggcctcaataaatgttagctagttttactagtattatataaagtatctaatttgttgaaaattcctgtttatggtaccttttcttaggccattttgtgttgctgttttaaaaatacctgagactgggtaatttataaagaaaagaggtttatttagctcatagttctgcaggccgagaagttcaagagcatggccgtggttttggtgagggctttcgtgctatgtcacaacatggtggagaagatcagaggagaagcagacccatgtgcagagagggaccaaacaggaggaggaacctcactttataacaacccactcttttgggaactaacccctttacactaggactaatacaatctcatcagaacaagaattcactcactacagctaaaaggaaacaaagccattcctgagggatccacccccaatgacccaaacacctcccactaggcgccacctcccaacacattcaggatcacatttcaatatgaaatgcatattgaaactatagcatagctattatcagttaaaaggagaaaatgggggcttccaattagctgaagataatggtggcagccagatgcccatatcccaatatttcctccccaaatgatatagatcaaaaaagggagaaaggaaaagacacaaaaatcacacccttggcataccttgaggacagagagttaaaaataactttaactaaagagagaaagaataccaaatccaagcacaggaaaactcatgcttccttccagcccaccccactacagggctttgaggcaggcagagagaaagggagctgatctataaggaagagtgaaggagagaactagtatagaggcctataggtgatctaaaaccactcccagccacaagtccacccaaagcctgaaaatacaacacgaggtgtccaggtcgatcatggtgcagtgtacaggacagtcacaagcccatgcgacttgagaggcagccttcagaatgcacagcttctcaggtgaggagaacaggagaaaggaaggagggagtgccctttggcaactgggtgataagacggtgaaggagcaaaaggggatgattcaagtggccactgttaagagcccacagatacaagttattgtatagaatggggaagcatgagggaaaatgtgccagagagaataccggaaggaatattaaatcagagagcttagaaagaaacaaatcagaaaacgaggcagaggagccatgcggaagggtgagatgatgtaatggaaagggggatggaggacagcagcatgaacaagatctatgagaggtgcatgaaattggggagtgaaggagccggctgggggtgggacttgctgggacacagcagcttcagtggtcaaacttggtgttcatttcaggacaactcttgctcaggggaagtaggtgcataggcacatcgacatagacacacacctgtctcccagcaagcctctgccagaggatcccagggccggcaggcaggcaaagaagtagggcacatccaaggggctctgctgtaaagaaagagtatgcactgggatccagacgacagaagaggaggggacatgtggtgattatggacatcatagaaaagaaatgctgtagaattcagatcagtccaaaacgcaccatgtaaaacaaaagaagagagggcaactttggtaacactgattaacatttaggattttgaaaatttatggtgtttgcaaaacctgcatttgagttaagtattttgcaggggagatgttattggttatttgtagaacatcatatctttccagttacaaaatataaattcattttgcagcacaagatatgatgtctcatctttgaagttcttttttctctatgtatgcatggaaagggaacatggtagaaataatcctttttttttttatgggggtagataatagatgaaatatggcacagaacccccacttcagcacgtgaatgagacacagaaggcagttctctcactgaagaaggggccaagggcctccccctcatcagctcagccccttctcacactgcagagtccctcgggaccgccccaggacctgggggctatgtggcacactccttgaaaatcatttggtacttgtcacttcctgatgcctattgcagtagatgttggagccacacagataaataagtaccattccctgcccttggataactcagtctagaggagagacagaaggttaaacaaccatctggaatgtagtcagctgggtgctaaggtagaatctgagggagaagaataaactctattagagtggccgttatcaaacaaaagataagtgttgacaaggatacagagaaaagggcccccttacacactggtagtgggaatataaatgagtgcagccactatgaaaaacagtatggaggttcctcaaagaatgaaaaataaaactaccatctgatccagcaatccctgggttgctgggtatatatatcaggatcaggagatcctgatttcaattgagatcagtgaactcccttatttcttgcagcattatttacaatggccaaaacatggaagcaacctaaatgtgtatttatagacgaatggatgaagaacttgtgaaatatatacatgcatgtatatatacatgaaatatatacatgcatgtatatatttcacaagttcttcatccattcgtctatacacacacacacacccaatggaatattattaagccttaaaaagaaaaattctgacatttgtgacaacatgggtgaacctgaaggacattatgccaagtgaaataagccaggcacagaaagatgaatattacatgataccacttatatgaggaatctaaaatagccaaactcataaaagcaaagagtagagtggtggttgctagagcttggcaggaagggggaaatgggaggtgttattcaaagggtacaaagtttcagttataaaagattaataagtcctagagctctacgatacagtatagggcttacagttaacaatactgtattgcatacttaaaaatgtgttaaaagagtagaccttatttttaagtattcttatcataaaatggtaataataaagaggatgggaggaaacttttggaggtgagtaatgtgtttatggcatagattgtggtgatgtcacagtctctaaaacttatcaaggtgtatacattaaatagctacagcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatccagcttttttaatgtcaattatacctcaataaagtggctttctttaaagccaattattccatttgtttctctgcattagacatttcacattttacttgacagggacagcccagagtttgccaaagccacatccaaacctgagtccatgctgagatcatacagctttctataccatactttcatcaagagcttccatgcctggaagtgccaagcaacaggaactggttgagagatggcaggtccagaattctgttcttgatggaatgggttttctatattaatatgacggtctttgttgtttcgtggccagtctcatcagaagggctttgtggggggcaaattgtagtcagttttaaaaattcaaataattccaggagtaaaaaggtcggttcattttaggatatctattacgcaccaagatgttaagagaaaaatatcatcttaattgatactgaaaaattacttgataatatttactacccaatctgtacaaattaataaaaagctatgaatagaagtaaaattccttaatttgataaggaaagtctactggaattcagtagtattcatcatacctaaaggtgaaacaagagagccaatcctatttcgaggaaaagataaggatactcaatatcactatgaaggttccagccaatgaaatgagacaagaaaaataaatgaggtataaagattgtagaaaaaggataaaacccaccttatttatatatgacatcatttcttaccaacaaaattattgccaacttatgaaaaactattagacctaatcatatattcatgacactgtccagatcaagtaaacatttaaaactcaatagctttcctatatataagcaagaaccatatagatcaggtagttttaacaagatgccattcactatagcaagaaaaatattaaatatttaaaataaatgaaacaataaatgtacaagaaccataggaaagaaaaacaaactttactaaagggcataaaatttaaataaatgacaaaacaacatatttcagtcgaagacaactccttactaaaaagccatcaatttcccccaaattaatccataaattcaatttttaaactcctcaatattccaatggaattttcatgagaatcacctgattttaaaattcatctagaagagcaaatgttcaagagtagccaaaagcttttgaataaagatgaagtgaaaatatgtcctacaagatatgaaaattttataagcccacagcaattaaaacacgtggggaaggaacagggataccaaagagatggtaatgaaatgaaataatctagaaatagacccctgtttgtagtatatgataaaagcacatttaaataattgaggaaacaactcaataatcagcattaggataataattattattaaaaaataatgttagatctctgtgtcacagtatataccaagataaaaactataaatataccaaaagaaaatatagaaaaataaaatctataaaaatatcccagaaaaatatttttaaattttgtggtgaggagagactttctgacaagaactaaactcttttggcctctataagcattaaaaaggtttacaaatctgatttaataagaattgggggcttctctatgtcaaaagacactattaaagtcaaatggcagactgagaaataatatttctgaacaaagtgctaatagctaatatccttaatattttttaaagctcctgaagttcactaagaaaagataaaacaacccaatgtaaaaaaggcaaaggatgtatgtaagtaattcccaggggaaaaagtaccaatgatttttaaatatatgaaaagatatttattacccactagtaatcaggacaattcagattgttacagtggggtacaattttacctggcagattacagaaatttaaaatgatggtaaaatataatatggggtagggagctgggggagaagtttgtgactcactaagtattgagtgtataatgtaccacagtaagcaaacccttgatttagcaaaatagtcattaagagcacaaagacctttataagaatgtccattgcagccagttttataagctgaaaaaattaaatgcaacctaactattcaacaatagaaaaatgattaaatgttacattatttccatcctatgaaacactctttagccattaaaaataatggactagctctatatttaataacacaaaatgaaggtccttaaaatgatggtgggctaaaaaaattatagtagggtcccattttgtattaaaaaatacatgtgaacttttatataattttgtttatgcctgtccgcacatgcacagaaagatctggaaggattctcactaattgttaaaagtggttatccttgtggagtgaagcgagattggggccaagcagaagaagtgagaccttccacttcttttaggaggcttaaattgtttttaatgatcatgcattgcttctgtgatttaaaaaaaattaaaattgtgctgatgaaaaacatatggaaaataaaactgccagaggtaacactgctgcacagcctataaatcaaatctgaaaagtgtctttggaccagatgccccctgccaggcctcctctccatctgaggtattctgaactgacagtcttcagaaatttgactgtctgcaaatccatccgtgacttcctccttatgggtcaggtgctcccatctgcttgctcttcctgctgctcagaattcttccttgagggcaggcctcgtccaggggccccccagaaccactggaccctgcagcctggaatgttgtaacgggaccagggaaagacaggaggaagttgccatcaagcctctgaagctcatagtcatatttaaactcttagttaattgattcatttcatcattttgaactcattgttttaattacattgaatcttttaaaagaatttttcacttaaagagtccttggagatatccttttgttcaatcctaacattttatgtgtaaggaaggggaggcccagagaaggatggttaataaattgtattagatttaagaccctgaatttgggggctcaagcctcattaaatttcttgattcttatgtgagccaacttctgcccctcctatgcagaatgttacttgagaatgctattgccaccctgtaacccacacacctccagaagagccaacatgattatgtctcttcatgaggacaaaagtcatcaactgggctttctgtcatgtcttcataccaagttcttctgaccacggggcctttgcacagacagttctttctttctgcaatgcacttccctgctcttcacaaggctggctctttccacacactcaggcacctccttggagaggcctttcctgaccactgcactcccttcccaccattctccctttcagcaacctgtttccctcaaaggaggcagagtccgtgcctctctgtccactattgtatgcatccagcacatggcacattagtgggtgctcaaaaaagagtttgagtgaatgagcaaatctgacacctagttttgaaaggtttctgacccctgctcttttttttttttttaaatggagtctcactctgttgctcaggctgtagtgcagtggtgccctctcagctcactgcaacctccgcctcctgggttcgaaggattctcctgccttctgagtagctggaattacaggcatgtaccaccatgcccagctaatttttctatttttagtagagacagagatttgccatgttggccaggctggtctcgaacccccaacctcaggtgatctagctgcctgggcttcccaaagtgctggggttataggcgtgagccaccacactcggccaggctcctgttcttatgtgattatctcatcatgtagacccagaaatctctattattatttaatttttctgttattattatatggcaggtgaaaatgatagttttattattttaatttgtgttagattacaagggagatttaacatatttccattagcttatgtcatttgctcagctgtccattggcatcttaatgtttcactcaatcattcctggttagtggcctgattaagcaagggaggaacctatgagtggttataacctgagatacagcaaagagaggggacagggtcttacatcgcactggggacaggtcttacatagcactggggacagggcctcaagggcttggtgctctgacacacaggcactgagtccagctgcagggctcagctgcaggcctaaggttctaccacagcctggggtggatggagatgggtctaattcctagggagcctcctcaatttcttccttgtcagcactgtattctgcgcctgtctctggtgaggggcaaggatcttggcaaattttagccaatatttaatgaaaaactctacaaagattggggttttttgttagtttgtttttgtttttgagacagagtcttgctctgtcgcccaggctggagtgcagtggcgcgatctctgctcaccgcaggctctgcctcccgggttcacgccattcttctgcctcagcctcccgagtagctgggattacaggcgcccaccaccacgcccggctaatttttgtgtttttagtagagacggggtttcaccatgttagccagaatggtctcaatctcctgacctcgtgatccgcccaccttggcctcccaaagtgctgggattacaggtgtgagccactgcgcctggcctgaaaaactctacaaagtttttaacagaacttaaagtgatttctccccaagaaaccagttttcttagagttagcaccctaacatgaagattgctaagtgacaagatagcacattacattaatccttgatatggtttggctatgtccccacccaaatctcaaattgtagctcccataattcccacatgtcgtgggagggtccgggtgggaggtaattgaatcatggggacaggtcttcccttgctgttgtgacagtgaataagtttcatgagatctgatggttttataaaggggaattcccctgcacatgctctcttgcctgccaccatgtgagacatgactttgctcctccttcaccttccaccatgatggtgacacctccccagccatgtggaactgtgagtcaattaaacctcttttcccttataaattacccagtctcaggcatgtctttattagcagcatgagaacagactaatacaaccctgtattatataattcagagctaagtatttattcagttattatgcatgtatccagcaatcaccatgaaccaggcacttggtcctggacatacaggggccggttggctacaacccctagctacaatgatttgtatgacagaccagggagaagcatgatggcagtgaaaacagcaagtgtgttgcagcctaaatccaagtttgaatccagactgtgacgtgcagacacggcaagccttagcctctgtgaacgagaagtacatagtgataccatcttcacggactctgatgtaaagtgtttggcctagggaaggaataaaaagtccactttgggccttcaaatcagagagaaaccagtgctatatgaagtgatcaagggtggaggaggtgtagaggaggtagaatgtgggcccagccctgaagaatgggtagaatttggaagggaaaatgcagaagccaaagaatgaagataatcctaatccactgaagggcagtcaaggagctggaagaatggaagggtagctggaattcttctacccttgcagggaaggagcagggccagagggatgggcacccggagccagcccacagcaggtgtccctcaaactgagtcttcaaatacttactgaactttcattttgaggacaggctgagccctgtgtgtggagaggaagagcaaggcgggcggcacctaatttgcacaccgcaactaacaaaactaaaaccccacagataaccagacccacattcctcagacgccattggactgacttctattgttaatgaagtattgccttgttggggagggaagtgtctcctctaaccccgagcagcttatccaggacattcttcttgccatgcacaggagttccatcatctccttgcatatctggtcagatgttgctgtcctggaggtgttttagagccccttatagaccaacactctcagcagctgccaggctggcccaccccttattctagttctcagaagagacaagctattccagccctgtgtcaggacagcagccaggaggaaatgagaagctcctgcagctttttcatcagtggggaagattttgcagtcattcagtcattcaatgactacatcatggtcacctactacatacaaggagaatctaaaggagaaaaagcgcaagacatgaactcttccctccaagagtttgtggcagttcatataatgagggagataagtaaaatgccctatatgccctgaaagaaatacagaaactgtgacggtaatccagagtggggagacattacttctagttggggtggcagggagagaggcagagaatgctttgagaggagaaggatcttgaaggatacacaggctttgggacatgcagacatggtgaggaattgcatctagagaatcataaagcctcagagattgtgtaaccccttatttcacatgtgaggaaactgaggtcgaggctggtaaatggcagattttgaaatggagcttttttctattcagcactctcctcacctggggctggccttccgaacagaagacagtgtgggcaccaacctggggtgtggaagttttgactgctcatggtggaatgaggatgcagcttgcttgtaaaataggattttgtagttgattcgctgctaggggtaaaagaagagccaggggaacccagaggtctccagcctgatgactgggaggacacctgagccagtgaacaggaggaggcagggatgggagaaaaaaatggtgtgtttggtttgggacatgttgaactggaggtttttataaaatatacaggggaaatctctaacaggttggggaaacctggtgctggagttcaggacaaaagatataaattgtggatagttgggattgtccaagggatagaatgcagagaaaaacagaaattgaccagagaaggttggtggacagtggtgagcatagccaccttctaaagactgtagcaccagctcccttcggagaggagaaccaggaactggacccgaggtagacagaggttggagaatgcaatgccctggaggtgaagatgagagatttggggagaagcagtctacattctagcaaaaagggttaacatgctaccaacgtgacatctgagaaaagagacagctgcatctagcagctacaacatctcgcatgacctttgcaggtgcgaggcagccagagtgaatgttatctaggaagtttgacactgaagaggaggaggaggattaaggggtgccagaactgaggcaagacgtggtttgtcttttcctttttaaggctaggataattggaatatgtttcctggaggatggagaggagttggcagagtgggagataagagatgggagggagaagggatgcgtgacagaggataatcctgaaggaggcaggaggggttaaggtcaagggtgtggcctactgacagttggagttagggtctctgagctgagatgggagggtggttctgaagggtgaaacagaggggagcctagaagtcccagcaatcaggtcagtctcacgcagcacgaaaaccacaagctgagactccaaccttgggagaaacccaaagttaagggtcaaaaaggcatcaaggatgggacaactgaaaaacagccgtgatgtccagaagcccacacgagttggtcagtagtacccagcccagaagacagggctgactgaagatgaccaacaaggataaagtttgcttttgaagacagattagaataagctatagtccattaaagccacataccaaatgcatgatttccctgcttgttctgcactttagagtccaaatattttaattaaaccaacatgtgaatatcagagatatcaaaagaacaagaacattattaatttgggaaccaaggcaactaaccactttattcttttaagtcatttcctcatttagctccaatctcggtaacaaacatttcgatatctctacgataattttcctggatttaaaaccacagttttgatttttaccccttggggatttatttcttatctcttgggcccttttgaacaaggcagttatcagattaacttttagctcactggcctggggttgaataggtcatttccctcctgaatcataggctcctaagaattcaagccaaaattccaggctggctttaagtaatgaatactgtaattaacttctaaccaagcaagctaacattttgcttggagaaagcatccttttcccaaacaaatgcctttcaaataaaaacaatttcatgccctctttttccagcctgatactttccagggcttgggaataaccactgtgttgtgcaagagtatattcttggagcctcttaaaatccagtttgctctggtttttggttctgccatagaagctgcaccatcttttaggactatattgtttttaagagagttaactgagttcccttccatctgtactgtctgggaagttttgtggaagtcctgccaagcctggttagatgtgacttctgtctgcccaactcactggacacaggacaaaaacagatcccagaccttagcagattgggactgcagtctgtgattgaacgtcatcaatgacctgccaaggctggggaggagggagagtaggagtgctctgacccagcaggggagagtattttacacgatgataataaaaagcaccacttctagacagttttatgactgtttttcatcctctgtagacaatgcacctccttattgcctgcatctgggacctaccacgcccagtgcctggccaagggctatcggccttgtctttagcccaacccatgaaataagtgaaatgaagacctgtagtagggtcagtaatgggagtttgaatgagacagtcttgagaaaataccaaacgtgcagccagaaaaacaaactatatagaaactaactgaaagggtatatcatttaagtgtcagctgtgagattttttttcagtcctagggcaaagccatgtcaggaaccaaaaggagaataaggcatcacatatatatatgcagcaaggaattcatcttgagctgggttaggaatttttgccaaacggattttcattctgacctggagtgtcttttggtgttttgtttagtttggtttggtttggtttttggctgagccatgcatgtggcagtctttctctgaggaagtttttaagtcaccacctaatttctgtcagcacttaaagtgaggggcaaatagcgttgccctgaaacctggcctattttctcagcactgtggcaaagacccctgtcctgctgttatggtgctgcacacagctgtgcacagagcgtgggtggccctggaacactgccacacgaagcagcgctaagccgaggtttccctgctgtgaggtcccgtccctggactaccgtggactgtgcagttacgtgggaggtagagtcgcgtggtgtacagatcacaaaatggattacatcccctactctgctacatactaaccatgtggtttgggggcacgcctattctttgctctaaaactagctttctcacctggaaaacgggattggaataaggacagccagggggaggagtaattaaaataaggtgtgtgaatttactctgcgaactataaaatgctacagggatgtaagggtgaattgcctacaggttctgctgatttggttttctggttgtcgttaggccttagccagtaattagtgaccaaatgtaagatgggggaaaaaagggtttagcagcagcacctgtgtgaaaaaaaatcaaagcgtttttatcatgtaggtggggttccatggaaagctgagctgcagcaattgaagtggactgtggagaagaaggggcatcacggttctgctctcctgtgccatgatcagacccgtcctagttattaccttccaggggggctcctcactggtctatagatgacgtagatcagccggataacatgtggcaggaggaggcatctaggaagcaccaggaccttaactggaaacgctgggaagaaagtgaagctgtcttcgtattttcttaagggtcttatgtagaagttggatttgacttgttatcccagctttccagggaagagtaagagcactgggtggacacatgcagggtgtagatattagcttatctaaggcatggttcccaaactttgctacaaatcagaatcaccaggaaactttcaaatctcccattgcccaggccatacctgaacccattaaatcagaatttctgggagtgaggcccaggcatcagtttaaaaaaaaaaacttttcaggtgcttgccatgggcagccaagtttgagaagcagtgatgcatgcagtagtaaaagcatcaggactagtcaagacggggtgagcggctagggatgtggggaatcccctgcctctgaagctgctcagatccaggctggatgtcacttggtgatgatgaattcaagccttccgcatagaggtagactaagatagataaacttcaagctctttcccatcctgagggggctgagtcaatgctccaaagtggaagttttccagtttatttaattccaaggaactatttgttcaaataacataaaatatttaaaacaaagcaacagggaggtgcccccctccattccattccaccctctgttccaggatgacctctgaggacactttgtagaaatctggaaacttaatgaaaatctcttggactccaaggaacacagttttaaaaaccaccaatttaagggaagggaaataggatttccacagaaattattttcttactcagccatctgtagttggaatcttgattattttgatgaatagaagtagcaaatcccaaatggaggagggccaagataaatgaccatggacctaatctgtttattagttgggaacatgaacagcatcagccagaatgtggttgacccagtgcctcagaaactagacccaggtcaattttggcttattatcttggtgccacatagaggatgtaagacccacctcatctggctcatacggtatcttcaaggggaaaaatactttattattatttgtgaaagttcccaagctctgcattcacaagttgagtgttaagcctggattgagctctttccttatgacctgcagtgagcagagcaggtcttgaacctaggtattctcagtgccaatatatttttacaatttcatggtacgttctgttccacacagactctagttctgtatcaaagctgtaacttacaaatgaggaacaaaatgcagcctggtacaggggaaagaagtagcatataggtttgagtcctggttcaactcttcaccagctgtgtcagagcagacaagtatctaacttagtttgcttgcctcttaaatggaattcattatatctgtttacctatttaccaagattattgtgaggttaaaagaaaaagccaaagtcatatcctcttaagttctataaaatatgcatgattattgaaagcaaaatatatatatgtatatatatatacatatatatatataacattgggagaatttcaatatatgtagatgaaatacacatggcaaatataacataaataggggagacttgaaggacctttattttgtgtttgtttggtttcagattttttttgaaaataggctttattttttacatcagttttaggttcacggaaaaaccgaaggtacagaaaattcccctatattcctagcctccacacatgcagagcttttcccattgttgcttttaaaatttctacattttgtttgaaatggtaaatattaactcaaagtagactatgacaaattaggtttgtatgttttaacacctggacaacaactaaaaaatagttcaaagagatatgaccaacatgcaaatagataaattatacagaatactgaaaattatgcaagtacaaaaaaagaaaggaaaaagaacagaggaataaaaaaggtgacaaagaagagcaataaaatagagcgaaatctagtcatgactcgttgtaaatacagatggtcagattagattgaaaaagaaagacccagtgatatgctgtctataagaaatccactctaaaggtaatgatatatataaatagatttaaaggaaacacatttttgaaaagatatttcggggaaatactaatcaaaagcaggagtggctatattaatattacacaaagtagacttcaaaacaaggaaacattaccaagaatgaagaggcagattacatgataataaaggggaaattaaccaagaaaacataacagccataaaggtatatgcatctaaacagcaaaactctaaaacacatgaagcaaaaactgatagcgttgaaaggagacatagacagatccccaacaatgcttggacactttagtcttcttcttaaaataattgatagaacaagtagagaacttgacctaattgacatttatacaacactccaaccaacagcagcagaacacatattcttttcaagtgtacatggaacagtcactaaaataaactatattctgggccataaaacagactttaaaatttttaatatagctataatataaacatcgcttttctcatcataatggaatttaactggaaatcagtaacagaaagagatctagaaatttcccaaatattaaaaaataacataggaatgaaacaacacacttctaaacaatcactgaattaaagtggaattctcacatgaacttagaaaatattttcagctgaatgaaagtgaaagtacaacatgtcaaaatgtgtgggatgcagctaaagcagtgcttagcagaaatctgtggcattaaatgcttatcctggaaaagaagaaagagctcaaatcaataatgtgatgttcaaccttgagaaactaggaaaagaagagcaagttaatcccaaatcatatttctttggattttgctttgcagaagggagaattgcagaagggaggaaacaataaaaacaagagcagaaatcagtgaaatttaagacagaaaaacaatagagaaaattaagaaacaaaatacttgttctttgaaaatatcaatacaattgataagcctctattcacagccctttaccctagtacaacccaactattcctcaactaaggaatgaatgacctagggtacatcgatgaaatggaatactactccagcaataaaaagaataaaccactgatacacacaacatggattaatctcaaatgcattatgctaagtggaggaagccagactcaaaagactacataccctatgcttccgtttgttatgacattctggaaaaggaaaacccataggtgtggagaacagagcagtggttaccagggacgaacgactggggaaggggaatttttcaaggaggtgaaactaataaattttaaaacatcaagtttacatctgtaaaagttgaattaattgttgaatcaacatactgctatgataattgttaatattatgatcaataacgaggtagcccaggctcctcaagccaaggaaacctgggaagtttagtttaaaaggcttttgggtaatggtagaaaacagtgactggaatcgtcttaatccaatatgccatcattgtaatcttagaaccccatatgctctggtccctcccattgggcaggacagctaccacagtgtccttgccaagcattaaattccccctgttccagggctgtgtggctaccctctggcctttgggaactgccctcaggaactgtcttggtccttcctgctgttttcctaatgagctcctagtatcctctgcagggccccagaggctgttgtatggaggtcactgtgcccacatggccctccgcccacacctatgttgctgattctttcagcagctgttgccccttggggttctgaaaaagagatatagtggggtttacacaatcttacagcatcttacgttttattgatgtcatgctcgaatgtcttccatctagcttgaaaatagatttatataaagcttcattgtgatatttcacaatcccctcccatcgccatgacaaccagggtatcattagggaggaatcagatgactactgtgagctttgccaccaaatcggacatcaaagtagaatttagatattaagtctctcatcctgcctctaccccagataaattcatttccaacttctaccaagttacaggggtcatttgagccatcttaaataatagattagaaatgattaagatagtacactaaagggaaagcattgatgttttaacaggcctaactagttaaaaggatttgtggatggatgtgaaacctaaaaaaaattgtactggacaatgtttcagaacctgtgagaagctgactgtccagttgcccccacacctactatcttatttccttgttccaatgtggagtagaaggtgagccatagaacaagacaagcagatatggggtcaagtcatagctccaatagttacttactgtgtgactttggacaaagtacaggttggtgcaatagttattgtggtttttgacattatttttaattgcaaaaaccgtgattacttttgcaccaaccttaatacttaaccttcctgaacctattcttctcatccacaaaaccctgtcccagaggattatgagatgaagatagtttatataagcactgaaatgtaagctttatgagggcaaagatgtgcggtgggtgttgtgtgttggggggggaggggttctgttttgctcactgctgctatccccagcacctaaaacagtgcctgacacatagtaggtgctaaactactctttgttgaatggcggaaaatgcctggcagggtggtgcaggcatggggtggacttttaggataggttaggataggttaatggataagctttaggagtgtctattgtacatgacttctaaaatttaaaagcagaattaataaaattaaatatagctaaaaggatgctgaagttttgccttggcattttcttttcttaagataatgctggccaggagcagtggttcactcctgtaatcccaatactttgggaggccgagtgggggtggatcacttgagatcaggagttcgagaccagcctgaccaacatggtgaaaccctgtctctcctaaaaatataaaattagccgagcgtggtgacgcatgcctgtaatcctagctacttgggaggctgaggcaggagaatcgcttgtggaggttgcagtgagccaagatcatgccattgcactccagcctgggcaacaaaaccgctgcaacacacaatttacccacataacaatcctgcacgtgtacccccaatcctaaaataaatagatgaaaactaaataaatacaaataaaaataatgtcttaaattgttactgtgacagaaatgtctcctacctgttcaactagtgagtgggtggacaagctgccatcattagatacataacccttataactccagagacataagtgggtcagtcttgcaggagtatggcatgcgagaatcacaactcgacactcaaaataattaaacaggaatttgtttatgtacatctgttcccaaaggacattaaaattgatattcagttatcgcttggagttctaatactcaaaaacaccaaagtttgggttcatttgtgtctctacaaaacccttgtattaaattagcatctatgtacatcctgtgttttttaggttaactacttctgccattagcagtccgtttggtagtcaggaatgaattcctgccatcatcttggaacccatggcgacagtgccttgttggttacaactctgaatggatcatttgaaattcccctcacaatcctgcatcttttcattggattcaagcttatacttcaaatttcctatgtttagtcctaacttttggaatttttgtttaattacccgaattcccagcattgaatgggctttggattctacagtgcttagaacagaaatggaatttagttgtgtgtttatattttttttaatgagaccaggtaattagaacagaatgtggaagccactgtgtgtgtatgtgtttgtgtgtgtgttgtaaaatcaaagaaagaactatcctatgttggttcatagtatagtaaaatttaaaacatcagctgtccatgacattgagaacaacccttccacttattccccgacgtcatcgcaatttagtcgcagatttggggctcaaaatttggaattaggctctgggttttttttttttttcctctatttaggataggtctatttaacactggcttcaaatattggtgttttagtcttttgcaagccaaccaaaacacccaccactccacaaccaccaaacatgccaaccctgaagcaagcacacacatgaattagataatagggatgtgtattagttacctgtggctgccataacaagataccacaaactgggtggattaaaacaacagaaattcattctctcacagttctggagaccagaattctgaaatcaaggtgtcagcaggattggttccttcctgagggcttagagcaagaatctgttccgtgaccctctatcagcttccagtgcttgctggcaatccttggccttccttggcttgtggcttcctaactccagttccagcctttgttttcacatggcattctcactgtgtgtctgtgtctgcctgtccaaattgccttcttttctaaggacaccagtcatactggatttagggcccaccctaatgcagcatgagctcatctaaataacatcttcaaagatcctatttctaaataaggtaacatttacaggttccaggtggatatgaattttgggaggacactattcaacccagtataggatatgtttggccatgcaattaccacataaatgaaagaagtaaatccacactacagtgcaatcgtgctgtaggattgcactgtagtactacgctagaatcgcactggagtattgatttaattctttttgttcatagagcactttcctgtttgttttatagagtgtggggtgtgtgtgtgtgtgtgtgttggtttttgtttttttttttgtagtctaatgaccagtgctttagatcatagctgactgtacttgtggggtgatgccaggccagcgagtgggctgttatcctgcccagccacggtgcacacctgaccgcacactatcatcctcctacccgacttccagggcctttttccctcaaaccaagcaggtctcacttcttggggcatccccccttgcagtatatacaggatgcttctttcctcatgtgttctggtcactcacatagaatcctggactttcctcatgtagaatcctaatatttaactccatgaggtcaccaaagatgtttctccatgggaacttctgggtcagacctgaccagatgaccaagagccataaaagctgaattctgaccccacctcggatatcttattttttagacaactccagttttccctctctgtgccaggaggaagatgcattctggggcacatgttgctgccttttgcatacatatgtgagccctgataagatacttttcctcttcctagtgatgggtttctgtttttgaaaatgggccttcttggcttctggtgttttgtaacaaatacctaatgagtcatcactaaacactagctctttactgacactgtggactataacaaagaaatttaaaaccaggctccagaggcctaggggattggctaagtaaactgaggtaggtgaatgccatggaattctatatggcagttagaaagcagttatctagatggacatttcagcaacaaagacagtgtaaaaagcaaagggaaaacccagtaacatttatgtaaattacatgtctgtatcacattagtgtaggtgcttgttgggatagccagggactgatggtggtggaatctggcataaagggaaaaataagacaagacaggtggaccttatacaacaaaattgccacaggctaaagagtctgattaattcacctttctgctcctgaggttaaaaaaaaatcttgagaaacttaaatatggcatttagcatagcaaaaaaaaaaaaaaatcacaaaagcaattgattaaacatcaaagaacagggcatagacactaagattagggatgagagttagaagcaggagctagcagcacgggagacagaggagcggtaatggggccattaagtgactggcccttgaacaagaccccccaccaccatgagagggggctgccagcattacttggcaatatctattgagtgtctgttggtcaggtactaaatgagacagggctcctgccctgtgaaaaacttacagcaggctgggcgcagtggcttatgcctgtaatcccagcattttgagaggccaaggtgggaggatcacttgagcccaggagtttgagaccagcctgggtaacaaagcaagtccctttctctacaaaaaaattaaaaattaactgggcatggtggtgcacacctgtagtctcagctactcgggaggctaaggtaggagaattgcttgagcctgggaagttgaggctacagtgagccatgatcatgccattgcatgccagcctgggcaacagagcgagaccctgtctcaaaaaaaaaaaaaaaaagattgcaaaaactggaatctgagtaatgggagaacaatttctttttttagaggagggaattaggaagcaactactttgggatgagaaagatatcaggtttctcttctagataaattgggctacaatgagacccattgacaaaattagcctcctggaattccttctgaagggcagacatagtccttccctgctcgtagcaagtggacagctcagcctgaagaggggagcgtggcctgagatggccacagttgcagggctggttctgtccatgggctgggagaggcatggtaggtacgtgagaactgtttgtgtcatgaatgaactttgggtatcacatgctacccatcttcctatttagctgccagcgtaggctcctaaaaccagatttcagttgttgtatcctgatcaaaaatcttttaggcatcccagtgcccacaatcagccgtcacagtctgcctgatgtcttccatccaaactcatctccaggggctcccatctatgcacgctcccagcgccccacaacttcccttctccatccttctaaggtcgtgccccctcctgcctctgtctttgtccatgccattcttcaagacccccaatgcccttccttcatcctctgtccggtgacccactcctccctgcaaatctctgctcaaatgccacccgctctctgagagcctctgcatctcgtggaaattttaccagcctctctggtcacgttgtattggcatgtgtctgactgctccatggactcagctcccaaagtcatgagctgtacctttacaacccccaatacttttttgaccagtttattttcttattataccataggtgggatcaatttcatacaacattatttgaggcttaaacatacataaactttctttaaagttaaaccacacaaactttctttaaagttagtattcaaaggaaatttggagtcagaataaatcaaaccttctaacatttaaagaatgagaattagacatactttgctataatttagcaatgaaataagaacaaagccttggcacttcccttcgttcaaaccccttacaacctgtgattagagtgccaaagagaaagccagccttctgattttcagtccaaatgtgttacatcatgttttagaaactcacacaggtttgagtccatccaaactcaaaatgccaaagtgaatctgactgaaaaaaaattactgtgtgatatctgcgtatatttgtttaacagaaaccataatttggacattacatcaaactagacttggtctacctaaggagaaatgtttgcttttcttttaacagaattttaatgcattaccgcatgtgtttgccattttggtcagaaggaaagaaggacattttggagattagaattcttaaacaggaatatccagatggaagcagaactcctaggcagtctatgggtaccttctcagaacagtgttttaaactcataaaataaaatacagaagagtacaaaggaaaccaattctcttgaaatacaattatcaaaacatgtattttttgagacaaggtctcactccgtctcccgggctggagtacggtggcacgatctcagctcactgcagcctcaactccctaggctcaagcaatcctcccacctcagcctcccaagtagctgggactacaggtgtgtaccaccacacttggctattttgttaattctttgtagggatggggtttctccatgttgcccaggttggtctcaaactcctgctcgcaaacgatctgcctgcctcggcctcgcaaagtgctgggattacaggcatgagccactgcgttcggccatcaaaatactctttaacaaacaaatttgctgtgtaataacatgtgctttttttttttttcttttttttttttttttgagacacggtcccactctgtttgagacagggtcccactctcaggctggagcgcagtggtacaattacggctcactgcagctttaacctcctggactcaagggatcctctcgcctcagcctcttaagtagctgggaccacaagtgtataccaccactcctggctaatttttttactttagatagagacaaggtctccctatgttgcccaggctggtcttgaactcctgggctaaaaggatccgcccacctaggcctcccaaagtgctgggattactggcatgagccactgtgcccagccatatgcttctttaacattaaaataggagaactcctagaagatctaataattatcataatttcaaaatagttatgagttcttaaataatatttcaaaatatcagtaacttctgtaaagtcccatgaatatctatatgatttccgttggtgatagagtcacagtcctgcatactattatgggtgttaccacattcataataaaacgaaatgctaaatttcagttggaggttagtgaaaagaaggatggaattcacagaacccaccaaggcagtacaggaagagttatatttcattttcagggtatccacattagctaacacattctgagacccatttgggttcatgcccatgtgtgggattccatggaagctcatattttagaccagaaatggcaaagaagccaggcttctgacctccagctggcattgtactggtggccaatgatgtctgacacttcagtattcggtttgttcggctacttaccgtagcttccaagaactgctgaagcattgcaaagcttgcgatttgttgctaggagaaacttttttttctttttaagctaacctatctcccagccagaaactaggaagaacttcaccttcatttctcaaagaaggaaacaaacatttagatcatagtcatgtgtctcctgtaaggaaaccagcttctttattttggttgtaggaacaagtggttgggtcatcatcacaatgggcattaagattatgggattatggccaggcatggtggctcacacctgtaatcccagcactttgggaggccgaggcaggcagatcacttgagatcaggagtttgagactagcctggccaacatggtgaaaccctgtctctattaaaaaatacaaaaaaagaccaggtgcggtggctcacccctgtgcctgtaatcccagcactttgggaggccgaggcaggcagatcacaaggtcaagagatcgagaccatcctggccaacatggtgaaaccctgtttctactaaaaatacaaaaattagctgggcatggtgacgcctatagtccagcttctgctactggggaggctgagacaggagaatcacttgaacctgggaggcggaggttgcagtgagctgagattgtgccactgcactccagcctagtgacagagcgagattctgtcttaaaaaaaaaaaaaattagctgggtatggtggcacatgcctgtaatcccagctacttaaggggctgaggcaagagaatcatttgaacccaggagacagaggttgcagtgagctgagattgtgccactgcactccaacctgagtaacagagtgagaccctgtctcaaaaaaaaaacctaaataaataaaagattatgggattaaagtatatgataatcagggcttgcatatataagctcttgttatatgaatcttggagaatggcattgttggtacccacagtttaggccaaaaatatttgcccagcaccaagactggaataaggggccaggcatgatggctcacacctgtaatcccagcacttggggaggccaaggaaggaggattccttgagcccaggagttcgaggttacagtgagctataatggtgccactgcactccagcctgggtgacagagtgagtccctgtctcaaaaaaaaaaaaggaataaaacccaaatgtcaaatgagagtgaaggtatctttatattgacatagccatgaggttgcccttcaaacaggctttgttaaagcttgaccttcagtgaacacagcgtctagcaaaagccaggagccacctgcacctttttgtgaggtagttctggatgccattcctagccctggaactgcttgcaggcatataaattgtagccgcagctgtttttgatatgcaaggccagatgggggctagtttttgagctgtttcagaagccaattcatggacctatggaatcaggaccacatttgctaataatctgttgtggcattttaaaaattatttgctattgtatgattcaagattaacccaaacctttagagagaatgagtgagtaatagtaatagatggtaaaaagattcaaggtaccaatttttaatctcatagggaggtccttgcagattcctcctgtgctgtctttcaaatggttctttaatggactttttagttaccagatgataacctcttctacgatattcccattaaaagcaataaaatcgtggccagaacctacctcaattctgcatttttgatgtgtgaatgggatcgtaagaagaagttataaaaaagagaaaatatctttcacaagtatttctgcttgtaccatgtccgttacattgattcaaaatgtttaaactttaaagaaggtaatacatgcatatggtaaaacaaattgtaaagggcagtaaagagatatcaaatgagaaataaatgtctcccttcttatctcccatctcaacataaaccccagttcctgtcccaaatgttaatagttttgtgactatccttctctaaacattttatgtatatattttctgtctatgcttttatttaaaagtgtgcacaaacgggattataccaaacacactgttctgaatttttctttcattcacaaatgtataatggaattctttccatacccacacacaccgacctagctcattctttttcgagtcacttggtattccattgtgtggatggccagtgttagaaccatcttaagcaacgttctatggatggacatttaggctagttttttttttctctatttaaaaaaaaatgggcagataatatccttgttagaaacatttttgtatactcatagaagtatatctctcaagtagtttcctagaagtagagtttttgggtcagggtgtatgggcatttcaagttttagccatgtaatcaaattgccctccaatatggctgagtctgtttacattcctaccagcaatgccatcaatacttccttgcttacccacctggcaatacttgcaatattaaattttttaaaatgtttgctaatttggatggtcaggatgatcccattgtggctttgattttcatttcttgaattataagtaaggcagagcctcttttcatttgcttatggagtacttgtacttggttttctgtgaattgcctatttattattctttgcttttcttttgagctctttgcccttgtctactgtgtaaacattcaattcttactatgtggtgagcactatgctagactctcaaactgtaatggagatgaaatcttttggagctggcagtgtactaggagacaaacattgatcaaataattctctcagtaagtgtatggacaaactgaattaaactgaattaaatgccttgaaggaaagtttcttgcatcccttagagcatggcagggaagagagggggctggactaggggtgggagaagactgccctggagaaattgacatctaaagaatgaatagggccaggcacagtggctcacacctgtaatcccagcactttgggaggccaaggcaggaggatcgcttgagcttaagaattcaagacccagcctgggcaacatggtgaaacccccatctctacaaaacatacaaaaattaaccgattgtggtggtgcgcacctgtgggaagctgaggtgggaacattgcttgagcctgggaggaggaggttgcagtgagcagtaagccatgattgtgccactgcactgcagcctgggaaacaggagtaaaaccttgtctttatttaaaaaaaaaaaaaaaaaaaaatgaatagaacttggagttgagggaggagcatttctggaagaagggacagcaccgtggagggaagatgatgttgtagatgggctaaaagaaggcgcaggagcagagcacagagagaagaacagtgatgcaagataaggctgggctgcagcatctgggggaggaggcctctatgatgggatatatatatatatatatatattttttttttccccccaagatggaattttgctctgtcacccaggctggagtgcagtggcgtggtctcggctcactgcaagctccgcctcctgggttcacgccattctcctgcctcagcctcccaagtagctgggactacaggtgcccaccaccacgcccagctaattttttgtatttttagtagagacggggtttcaccatgttggccaggatggtcttgatctcctgacctcgtgatccgccagcctcagcctcccaaagtgctgggattacaggcgtgaggcactacgcccagtcttttttgcctagagcaatagaaagccattgaagaattttgagccatcgttggtaatctaatctacattctgaaaatactgttctagctgaacagaagagaaacaggaagatcaattagaagatattttattagtccagatgagatctcatggtagcctggccctggattatgacagtggacatgaagagaggcggaggaggttaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtgataccatttactgagataagaaacactgaggccggggttgggttcagccttagacaagacatctgactaaagctggcaaggaggtaattaaataagatttgatgacgggttagatttggggggataggaagagaggaggtatccaggatgattcctgggtttctgattacatggatggtggtaccatttactgagataagaaacactgaggccggggttgggttcagccttagacaagacatctgactaaagctggcaaggaggtaattacatatgaaattctaaggccagaggcaaagtttggcctgtcaacataaatttgtgagtcattcacatatggtagttgaaatcatggtcctaggaaattgctcatgaaaggaatatagtgcccaaagcaggtctactcttattccttaagaaattctgatatttaatagccaggtagagaaagatgagacagaaaagaaaacagaaatgagcagcctgagagcaggaggaaagcaaggggagtgtggttcccagaagctggggtgagagtgtttcaaataggatggaatagtgccaagtgctgccgagacatctgaaaagaggaggcctgggaaacacccattggatttagcaacatgggggtcttggtgagctaattttaaatttcctcaatggaatgatggaggcagaagccagattggagatggttgaggaattagtgggaagtgagaaaatggtagacattatatggaccactttttttccttttttttttctgagactggagtgcaatggtgcgatcttggctcaccacaacctccatctcccaggttcaagcaattctcctgcctcagcctcctgagtagctgggattacaggcatgcgccaccatgcctggctaattttgtacttttagcagagacggggtttctccatttgttcaggctggtctgaaacccccgacctcaggtgatctgcccgcctcagcctcccaaagtgctgggactgcaagcatgagccaccgtgcccagccgcaccacttttgaagaagtgtgattcttcatagagaatagccccaaatctgttcttcctcagtttccacccttgacccttttttgctactcagtaagctgaattgatcttgtaattcagtagtgaaaggtctgcagctttgccctccctgcagccatggcaccagccagcccagtgtggagtctgcagggggagcccagctggagtttgggccactccagcccctctgtgcagtttctgattctacaggccagagctctgggaaggcccattgtaggaacgcggctgaaaaaatgagtttaagaaaaagttcttatattttagtggtacctactgaaaagttgaaggatacatatttgcaatgtgacacaagagaagccatgagctgatccttgttgaagctgagcaatgggtacatgggggtttattatattgttcacaccacttttgcatatgtatacatttttccataacaaattataaaaagttaaatttaggaattctataaaccgaaggtgcaaagagccagtggccatcacaggtccactatgtacatagcacttaaaacaggaccttcggctgggcgcagtggctcacgcctgtaatcccagcactttgggaggctgaggcaggcggatcatctgaggtcaggagttcaagaccagcctgaccaacatggtgaaaccccgtctctactaaaatacaaaaattagcagagcatggtggtgaatgcctgtaatcttagctactcaggaggctgaggcaggagaattgcttgaacccagggggcagaggttgcagtgagacgagatcgcaccattgcactccggcctgggcaacaagaacgaaacgccatctcaaaaaaaaaaaaaaggtaccttctctaaaccagtcctcctttggattgtgggtttccaggtgccaagggtagctgaagaaattctatttccagatgccaccctttcttctcctgttaactccaacaccttgttccttgcccccttctcctttcgtacccgcctcctgagtacacactagaaatcacaggtctgacccctatgggcctcatgaacttgaacaagttccctcccatctctgagccactctgaaaaatggggattataacatctgctgtgcaatgttgtgacgattaaatttgacagtgcacgtgcggtatctaacacagcccacagcctcagatgcccaggaactcaggaaggtcatagaagtgaatgaagctgaccaggtacatgagaaaatcatgtgaccctcttagctttagctttgccacttgtagtagacatgtaagtagagagaattataagaaaaattctgggccaggtgcagtgactaacacctgtaatcccagcactttgggaggctgaggcaggcagatcgcttgagctcaggagtttgagaccagcctgggcaacatggcaaaaccccatctcttaaaaaaaaaaaaaaaaaaaaaaatatatatatatatatatatatatatatatatatacacacacacacacacacacacacacacacacacaagccaggcatggtggtacatgcctatagtcccagctactcaggaggctgaagcaggaggattccttgagcccaggaggttgaggctgcactgagccaggatcacaccactgcactccagcctgggcgatggagcaagaccctgtctcaaaaaaaaaaggggagggctgggaggggagaaaaaattggataagaaaaagaacaatgcaagtatgataaatgatataaatcacccatattcataaataaaggggtaataaactgagacttaacctcagtgttggggggcaacagggaggggtggggactggggcaaatcagagcatatagggtccatctgagagggacagccatcctgggctccagccgattgctgccatgagggagtgtgaagccaatgttaacatgtcttcctggtttataagagaagccagaactcttaaattttttatgtgaaatatttcaattcttaaatttgggctcagttattttttttaataacactacagaagccaaactaaacccatttatgggccaaaatcagctcgtgggctgccagcgtgcaacctctcacctagataatggtatataatataaatacgtttcccttccccccttttttctcttcctcctctttctcctttccctcccattttccacatccttttcacctaaccagcccccaccctacatttctatactaagtccaagtgatagaagggattagggtgggttgaagcagtgattaagcccaaggggatgtaatctagatgcctaatggcgccccagggcctggatcattgcctggcacatagtggatcctgtcaaaaaccttgatgaatgaagaagccagaaactgggggagtcagttctgtttcttgtgcacaccctgggcttacccaaagaactgtctgatttttctcaacagccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacgtgagtttggatgtttctggactgttctttggattttgaatcttgtcacttctaaggaacatactctgaacaaataagcaacaaatcattgcccatactcaataaaaaccctttgagcagagcctgttggaggcactccttgaatgcttggcgttcatctttgcctttacttctgaatgggcccagctcacagcaacctccaactccaccagatgcttattaccttcggagtttattgacccagtaaaaccaattttacttgttgaaccaaatcagaggcaaaacatgccctttatttcatgagcattggatctcctccaggcactttccttatactgctaatttggcatgttttctttttatggcaaaagaaagcaagagcctaaaggaaggcaggaccgctcccagctcccagccctgttcagactctgagagcaaatgaagaaaggagagctccagagccctccagatgaaacaataaagctgagagtcacagtagagagatttactagaagctccctgcttcatagaagacaaaaccttaatttcttttacgtgaaactaagatattaaattgctcaagagttttaaatggtccttacgttcaaaggaaaccactagaattcaatcttcttaaaagaccaggaaataaagggtgataagacataaaagcttgaaataacattttgataaaaagattgagatcacccatgaatatacacattatttctgtccccaaagctgagctgattaacatatttgctgtgtcagagttttagaaatattattaattgcattgtcattacttctccacctacacacagttctatgtcctttcctcttgggcctagtagactcgaaattacaaaggaagccttgttgtagtttattttggattttttttttagactgtccagttggttggttgaatctgaatatattttaaatggcatcagaggtaaaaactcaggttgttaaaggcctactgtgggtggtctaggaatggaagccaacagcaatttcataaacgggacaaggttttgcactggcagaatgctcaggcagaagaggcaccagagagggagggaggatttccagccacagaccgagaggaagattgtgtgaaaagggagtgaggggatgagggatacacagcaggaacctgaggtcacacaaccgtgtcccttggggattcagtgcccaccacgtttctgcaacgccgatggtttgatattggttcctgggtaggagaatcccaggggttctcaggtctgccttcctttgggtaatttataaaatgaagacccatttcatcagtagggagtggcaagagatcatggcataaacaggaagaatagacacaggacccaccatgcaggagtgactcagagatgcttctagctggaaaggacctttgaaagtgacatgattctaacctcttccttccccaaggaagaaatcaaaaactgcagggtgaaggggcttgctctaggttacacagctggtcaataggagagctgctttataaagcagcagagacagaaacatcaaacccgaccgtgtctccttgcacggctcatatttacactgtggattctcattctgctgctgggtttagcccaccaccctgctccccatcaggaaatccatgggcagcaaagactgtgtgctctaaatccaatagggagggacgtattctgttgggccatgctcatttaatatgttttcagcccagacaatgttcagctgctgacttccacagtcctacgtagattcctgcttgccatcctatttttgtcatcattcctaagagaatatgacccagcaagagttgggtcgcttctacttgttttcctggccccatgtctttgtgtttctggggctttccctgaataagagggagggacctgggggccagcctcaccagccaggtcaagaactttgagggaacctaaagcatcccggggtggctctgtccaggaggtctgctgcttgttcgcatgactttgtcacgccacctagtgttaaaacagttctcctgcagtgtacacgtatttatctgtgttggatgtttcaagagcactgagcaaaatctaaggacagaaaggttctgctaccgttgctccatcttctcctttggagtttagaaaatcttgactcttagcttagtcttcttctgatttgctcggcctaagttcttcattcttcaaaagtaaatgacaaaaagccatccaggaataactttgtttaatctgccacaggttcactgatattactggatgcgtactagagtgaaccaacccagtcatttctcagtagttctgcaaatgccattgaaacccagaaggggtgtgcatacgtgccaagtgcggtaacactgatttttgtgtcagcagatgatacaccagcagccaaacccaggcgtgcactacgagtacgtgatcatggggaccaacgccatcagcccccaggtgccaccccacaggagaccaggtagaatcccttgtcttgtggccggggactctggtcatttccttgtaaagccttctctctctcaattcttgtgcatccaccctctgtctctcggtcaacacagagaaaattgagggacgcatatttcaaagccaaggggccttgacattggagcaggcttcaccatttgtctgagccttcactgatgagactgtttcattcactcgattccaaaatggcatgagcatcctgggtctgccctgccagttcaacatttgaaatgctttatactagtttccaggccagacaagggggctcatgcctgtaatcctagcactctgggaggccgacgcaggtggatcgcttgggcccagaggttcaagaccagcctgtgcaacataatgaaacccctgtctctacaaaaaaaattacagaaattagccaggcatggtggtgtgtgcctgcaatcccagctactcaggaggctgaggtgggagaatcatctgagcccaaggaggttggggctgcagtgagccgtgatcagaccactgaactccagcctggacaacagagtgagaccctatctcaaaattaagaaaaaacaacacaaatttactttcttagagctctggaggttagaagtctgaagtgggtttcattgggacaaaatgaaggtgtcatcagggcccctctctctccagaggctctaggagagaacccacttcctcgccttttccaacttctaggagccacctgccttccttggttcctggccccttcctccaccttcaaagccagcagggtggcactttcaaatctctctctgaccctggcctcatcacatctcctctctgactctcatcttcctctctctttcctttataaggacccttcagattacactgggcccacccaagtaatccaggataatctctccttctcaaaatctgtaatttagtctcacctgcaaagtccatttttgctatgtaaggtagcatgttcacagattccagggattaggatgtggacatctttagggggccattatctgtctactatatgccttttctcttggttccccttttgtttctgttaataatactttgacctataagacaagaataatgagttcacacctaacaatccatgttgagtcttcctggtgggctctgcttatggacagagcaggcagctttctctcggctggcactgggcatgggactgctctctgagtctgcagacatttctctaccggaggatgatggagcccaccacccaaatgcaggcagtcttttccttccttaaaataggaaggtctgcagaagtattcatggtaattatagctcacacacattgagtccttgctgtgtgcaagggcttagaaactgctgtgctgagctctttgcgtagattagttctttgaattctcatgacagagggaggtacttggagggaagtactattattagccttattttaagagtaaggaaatggaagcttaggaagagtaagttaataattgtcctgatctcacacctgggcagtgacctgaggagggcctgtgtgaccatactttgtgcttgttatatcactgagaggttacttggtccaatccctaccctaggaggaaataaaggcacaagtgccaaacccgccccatccattcttctctgaactttggacgggataaccaggttatctgattgctacagactggggaggacaacagctgggtgcatccccagaacatggggtgggtgtgttgtccaaactccaagtcagcaaactcagcacaacagagaatttttatgtcatgtccagaagcaatccacagtttgagaaaccaagtttgggtaagatttctggggtccattgctggtttacagggataatcagacagactatttgaaatctatcaggatgatgatgatttctgtcaggcctgatggggctcagctcatgaatagcatgggggttctgggatcagctccctgggacagggcaggcctggaggggtcacctgtaaaaagttggtaagcaggggcattgtcaccaggcttcctcttccatgtcaatggagtctggaggcagagttggaatccagctctgcacctttttgctgtgcaccctcaggcgggtcagcaacctctctgaacacacacccagtctacaaaatagaagaaaaaccctataaggtggtttttggcaggggagaggacatgggaagagattgaataaattagttgtccatcctagcatagagcccagaacaaggcactgaaaagacttcttaaatttttttgtccaacaacatcttggacagttctcatttatgtcaacatgcctggtcctgattttgttggtcatatttgcatgtcatattttaaaccatgaagcataataaccaactaagtaagaaagccctggcaaaaaagctgagaggtctggtgcagtggatcacgcctgtgatcccagcacgtttggaagccgaggtgggcagattgcttgagcccaggagttcgagaccagcctggacaaaatggcaaaaccccatctctgctaaaagtacaaaaagcagctggatgtggtggcactcacctgtaatcccaggtactcaagagactaagacacgagaatcacttgaacccaggagacacagggtgcagtgagcctcctgcactccagcctgggtgacagagtgagactctgtctccaaaaaaaaaaaaaaaaaaaaaaattgctgagaaagccctaattgttgttgttgttgttgttgttgttgttgttgttattgctgaaatggggtctcgctatgttgcccaggctggtcttgaactcctgggctcaagcaatcctcctgcctcagcctcccaaaacgttgggattacaggcatgagccacctcacccagcccccttgtagttttaactgtgttctacagtaaccctagaatttgcctccttattttctattaaaatgagacatacttgaacaatattcagtcaaaatagaaatatatacagtcaaaagcaactgccacataattgccaaaacttggaagcaaccaagaagtccttcagtaggtggatagacaaaaactaatggaatattatttagggctagaaataaatgagccatcacgtcacaaagagacatggagaaaccttccatgcatattactaagtgaaagaggccactctgaaaagactacctattgtttgattccaactatatgacattctagaaaagttaaaactatggagacagtaaaaaggtcagtggttgccaggggctgggaggacagagggatgaaaaggtggaacagggaggatttcagggcggtgaaactactctgtgtgatattacactggcggatgcatgtcactgtgcacttgtccagacccacagaatgtgcacccccaagtgtgaaccctcgtatggactatgaactctaagcaataatgacatgtccgtgtagggtcatcagttacacatgtaccagtctgatgtgggatgatggtagtaagggaccctgtgcctgtgtggtgggaggaggtgtgtgggaactctgtacttctactcacttttgctgtgaacctaaaactgctctaaaaaaaaaaaaaagcctattaaaaaaaaaaaaagtccacagctcccaaccccatgcccttcccagagggagtctaaccctttggtgggattttgcctagcccttttctatgcatacacaaacatgtttccagccatttgaatcatcatctacaatctcagatgtgcaaggaatattgcatattattattttccattagtcagtttaaatctgacctcaacttcacccttctttgaaaccagtagataattcaatcgcagtctgcttgggggttacacacacacacacacagacacacacacacacatattctcactccagatataaggaaagatctagagtcttagacaagccaaaacattggctagacccccctggtggtctgtccacactaattccgctgaggtgccaccgggagcagcctcatggggccttcaggttagggctctgctccttccagtctgcatggggggcacaggaagctggtgaggctggcagccaggccccctctcccgctgcaggggtggcttcctcctgggacactggacattgtctggtacacctaaggatccatggcactcaggaaacccaagactccagactcctacctctcctccatcttgaaaacctctctctctctttctcactctctctctctctctctctttctcactagctctctgtcttgctctctgtctgtccctctctgtctctcttaccatctccctctcttttgctctctctttattgctctctgtctctctcgcactctctgtttctctctctctctcttgctctctgtctctcttgctctctgtttctctctcttgctgtctctcttgctctctgtctctctctcgttctctgtctctctcactttctgtctctgtctctgtctctcttgctctctgtctctcttgctttctgtcactgtccctgtctctcttgctctctgtctgtcttcttctctgtctctgtctctcctgctctcttgctttctgtctctatctctctgtctctcttgctctctgtctctttcgctctctgtctctcctgctctgttgctttctgtctctgtctctctgtctctctctgtctctcttgctctctgtctctctcactttctgtctctatctctctgtctctcttgctgtctgtctctctctcttgctctctgtctctgtccctctctgtctctcttgctctctgtctgtctctcttctctgtctctcctgctctcttgctttctgtctctatctctctgtctctctcttgctctctgtctctctcttgctctctgtctctctgttgctgtctctgtctctctcttgctctctctccgtctctcttgctctctgtctctgtctctctcacactctgtctctctcttgctctctgtctctctgttgctgtctctgtctctctcttgctctctctccatctctcttgctctctgtctctgtctcacactctgtctctctcgctctctgtctctcctgctctctgtctgtgtctctctcttgctctctatctctgactctctgtcttgctctcttgctctctgtttctgtctctctcgcactctgtctctctcgctctctgactgtctcgctctcttgctgtctttgtctctctcttgctctctgtctctcttgccctctctgtctctctcactctctgtctctgtgtctctgtcttgctctctctatctgtgtctctgtctctcttgctctctgtctctctctctcgctgtctctctttcttactctgtttctctgtctctcttgctctcttggtctctgtctctgtctctctgtctctctctcacttgctctctctctcccttgctctctgccactgtctctctctcctctctctctttctctctctctcaaaatgtgccctcctcctctctctgggctggcccctcagggacatccactttacccttaatgaaagcctaggctttgcactcttggaagggaaagctgttgacttctagcagcttttgttttctgtcctgcacaaaaacaaagcaataacatctaaggacttggctactctttcaaaccggaggaggaagtggaggaataaagatagtaaatcacacacaaattagtatctcaaaaagtgacctgccacacctgtgtgtatgtgtgtgtgttctgcttttttctttcaccaaacaatattgtcatttcttcatgtcggaacgttatatttgctgcattcttttcaaaactcacatagtattccattttgtacttgtagcataacgtagtttaaccagtaccactggtgaacatttgtgtctgtttgctatttcaaataatacctcagtaaccatacctgtatattcagatttatgtacaagaaaatatttgcggaacagatgtgatagaaactgaattgctaggtcaaagggtatgtgcatttcaaatttggataaataatgccagatttccctccaaaaccatggatctatttgcaggctcatccatagtgactggaagtgtgttttcctgcaccttcaaaaggagtttagggatttaagggtttccaaactttccaatctttggtgttaggtggtggtgttcttttcatgtgtatttatggaattatgagtaaagttgaggatttttgtatgggttttggctgtttgtgtttctttttatgtgaactgtctatggctcacaattcctgttcctactgcagtgttcgtctttgtcttattgattttcaaaagtgctttgcatgtgagggaaagcactagtaggtgtctgcttattttaaacagatgtgcttatgtgctgtgacttagaaacgatctcatgctacacagtctctaatgtcgaagcaatttcctctttacaactcagggtctaaactgatcctgattctgtgtgtgcacgctcacctctcctaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggtgagcctgtgtgggggacgggtggatccctgcagaaccctaagcaaggagtgtgtgggtggcccaaggcagcggtccccggcttttttggcaccagggactggtttcgtggaagacgatttctccatggatggtggcggggttgggggatggtttctgggtgaaactgccctatcgcagatcatcaggcattagttagagtctcataaggagcatgcaacctagatcccttgcctgcacagttcacaatagggttcacgctcctatgagaatgtaacgccaccactgatctcgcccacccaccagtcacctcctgctgtgcgacctggttcctaacaggccatggactggtgtcgattgggggcccctggcccaagggaaatggcaaaccctcacctctgtgagcctgtctatgagatggctcatgggtgtgacagattgcattggggccctcaacaccaccctcaggtttaatgattggctcaaagggcttacgagacccagaagagctgttacaattcatcacagtcaaaggatagggattcgagttaataaaggaaaaggtgtgttggcaaagtcctggagatgccaggcgccagcttccaggtgttgcctccagcagagtcacacagggatgcacttaattctctcagaaatggtgtaattcagaggctgagaacacatgccaagtactgccaaccagagatgctcacccaagatttggtgtccagggtttttactggggtctctcgtctaggtatgcagctcccacatgagtgacactagctactctccctttaccatcccagaagccaaaccaatactgcgtggcccaagacctcagcataaaaaaacactcttatcaggtggcatattccaagggcttagaggttctctctcaggagctggtcaagggcctgtctttggcatgtgcagggtttgagcaactcaggcctgctgtgcacatatattcattaataaacggaatacactcatgtacttcaagatctaaaatttaatctccaagtcagggttgtggaagacttacacaaatcccagttgaaactcattctcaaatctcaggatttcagaaaaaaaaaaaaaaaacaaaactttgcaggcttggcgtgttagctggcttttacactgaccaacactcacagctcccatactatcccggtaaaatcccaaccctgtattcattcattattccaacctgatcagctaggaccaccagggacaaacctgaagcccaacaaagtcagctttattgacccctcaccacaagggagtccacacaccggaggaagcatggggcgtctctccaaacaaaagaaaagatagagttgtaggatttgggaggatacagtttaggtgaaatttaaataaagtagggttgtgataggctgaaagcaagacatggcagtgttacaggggtcacatcaggatgatgaagtggacccagggtcccgtttccttgaaaactccaaagttaagatacatgtggaatgtgctgtccagaaaccctttatctgacattccataccagattggaaatcaatgctgcttctgtttcaagctgactcattgcaaagatacacctatgaactgtgtagttataatttccttcatatatatgataatagcctcctgtttgtagtaaagtcctattttatcccctgaaacagctcttctttgaggggaggttgctaaagaaacaggaaggctgtatcccccaggaatctctgcaaactggggaactgtgtgatgtcccagagcattggtttggggtggttttttttttttgctttgctttgctttgctttttttttttcttttcctttcttttcttttcttttgatactggtatctaagagtacaaagtttggaacctctcacaaaattagcacactgaaaaatctcatgacagcttctaaagtttttatctttttcataagagcattggcttagtggcttttgagaatagaatttaggtctttggttcttcttgggggctggagcttttcctgcctggaacctctgcagttccataatgatttggtaactggagtgttgatttatagaggttttattgtgcaaattttattatgcttatacttaataaatgtgcaaagaatctggactgcagattcattggaccaacttcttttatatactttgtgaggaaaaattaaatgcatataaaatatgtcttgacagagtcagaaagctagaaatatttttgcattaaggccaaaaccattttggtgagactctgtgatattatagaggtaagcagtatgtaacataattgatataggaacccgaaatcaaaatgtattattattgaaatattctacctttaggtaatgtgtgatgcccatcaaaggaaccagatacactcagaactaggtgaaaatagggaaagtcataaaaaggatgaaagctgtcactgcgtggttttcaacaaagggtgccatgtggagaagattctctttcaccctgtccggagcccataggccttgtgttgtgagcaggatgagatgagggcaaatgcatgtgctggttccctgtgtctcctccagacgctcccacggtctctctaatggagcaaactcataaccaaatgttccagtttttgcccccacaacccatccgcacgctgtgtcatccacactgaggtatggagttgaaatttaaagaaagcaaggttttgatagactgaaggcaaaacataactgttactacctcactatatgctagtatccctcctttacgacactctggtatctggccagcaaagtcctgctcgtactccaagctctgagaccacctcttctgcaaagccttcctgattctgcaaagaacaggtaggcatttcatccttgggacctcacagcaattcaggacacatttctgtcccagccctgcttggcttggctgtctccatgaatatacactttgcaacttctgcaccaggcatcataccaagcacacagtaggcactcctgtgttttttgaataagtgactatatcatcaccacatttcaaatgcggaatatatgagctactagaaaagacataagggtagattttacatctttattgtatcctagatatacaagtctattactgccttttcccatgttctgtcaacatagcataaagaatgtggatttacctgttagaaattgaataagcggccgggcatggtggctcatacctgtaatcgaagcattttgggaggccaaggcaggtgtatcacttgaggtcaggagttcaagagcagcctggccaacgtggcaaaaaaccctgtcctcaccaaaaatacaaaaattatctgggcatggtgatgcatgcatgtaatcccagctactcgggaggctgaggcaggacaattgcttgaacccaggaggcggaggttgcaatgagccaagatcatgccactgcactccagcctgggcaacagagcaagactccgtctcaaaacaaaacaaaacaaaacaaaaaaactgaacaatctctttctctagatttccatatgattttgtttaatcttctgtcctttgcattgcagaaacacacacacagaaattcacaagagtgtgaggtatgggactgagcatgcacaggacccattttcaatatttagcccatatacacccatgtgtgcatgtacacacacacacacacacacacacacacacacacacacacacactcggcatctgccactcagaatgtctgaggcgacatgtctagctcttctttacccagtaaatggcaccagttctcaggcccaagagatactgaagaggtgccttggaaataaagcaaacctagggatgtgttgtttctcatccctcccttctctggcaatcctagttcctttttctttcaagtgacaagtggcagcggcccgtggaggcctctcctttgctctgtcccaggcggtgatggcaccagacatgcagggtaggtgaggcaatgcggaggcacagatgcagagcacatctaatggtcgtcagcagtcatggcaagtgaccaggaaatcccaagcctcccggcattgtccaagtcacttatgcacagaataagtctgttccccttgtgatcccattgtgtattttctcacataccctcgcctaaacccttctccagtcctccctggtggagctaaccacaccacacagttctgtgcttttcatggtcaaatttccctttgtctaagtgcttccagcatcatgatatcaccatctcagggaagggccctgttgctggcatccaagagtggtccatactcacacagccattgatcaggcctctgtcaaactcttggcttgtttcatttgattcctagagttccaagtctaaagtcatttacttttttcttgctctttattttgtctctcttccataatgtcccactgacctctacactagcccctgaattcactgacctcatttattatctgctaattacctgtgtacagttccccccttcaacatgacatatttctattttgatcaacatgtccgcatataaggcaaccgaactgatctcgaatagttttcctgctgcctgaagcccagccagtgcctgacctcaccaccttgttcctgcttgctagcaaatagaggaataattgaattgcaatcttgaacaatgggaggtggccaggtgctgtctccctttctaaatatattaaaactgacccaaagaaggaaaccactgcggtcactagactcaagagttgtagatatgggtcaggcgccgtggcttatgcctgtaatcccagtactttgggaggccgaggtgggcaaatcacctgaggtcaggagtttaagacaagcctggacaacacggcaaaaccccatctctactaaaaatacaaaaatcagccaggcgcagtggcaggcacctgtaatcccagctacttgagaggctgaagcaggagaatcacttgaacccgggaggtggaggttgtggtgagcagagatcgtgccacttcactccagcctgggtgacagagctaaactctgtctcaaaaaaaataaaaaaagatttgtagatctggcattttcccaccttcagagagccagagggcctctgagttcatttccgtggagctggaccatggacaatgtccataaacgccgtaaaatgtcaagggaagacaagcagtggccaggtgctggacaaccccagcaggacccatcttcccaagacacagagcattcctatgggagcctgtatccttttgattaaaaaaatttgatttctcccttatttgagtgccaagtggttgagatagttccttttgctttcctatccacaaacatctaagtggaaaagctaaacccgcatggtctgaaggaaaaggaataggctaaataagatctttacttaatcccttaatagccgggtcccactgcaagctgtgaaccatgtattcacctttataactgcacagtgtacttaatgtttgttgaatttaattaaaaatctgttctatttaatggaaggagatctgtagctggacaaactttaattccacaaaagttctttgcatcccattaactttacagtcagtactgccttttactcagccaataattgtgcttaattggaacgttattttaaataatggtctcaagttatagccacactgtaaatttttactaccagggtaatttaaacaaatgatcgtttcagattcaacactgtcttgcaaactgtcaagtttcttactaccctctgggtcagtgtgtcatacaagatgagcttgaaaaaccactgaaacactttcatgactgatgaaatattaagatgtttatgttaaaagatagcccctatgttgcagttaaaattgtaaggagttggaacttcagaaaatatgaatgcctggccaattagcaacagagataagacagagttgtagaataaagtatagtgttcttcccggcaggagttgtatactggcctggactgtggggaagacagttatttgtgaagaagcatcttcccgtggttggttcaggttcaggggttacatttctcacgttataaacgtccattaataatagctcagtgttgccaccaggtggcagcagagaaaggaaggcagaattgaatcagcttttttttttttttttttttttttaattgacacctagacattccatttaacaaattctggctttttatcgaaaatagatgtatccttattaatccaatgaaagtaaaacaaaaaacctaaaacagttataaacattcattcaacaccattcaaacattcattcaacacggtcatttattgagcccctgctactctcctaggtactggggctacagagattaagaagtagccctgtccctcagaagctcacggtctcatgggaagtagacaaatgctcagatcactgaaataccattggatgggtactttattagaagaacatgaaagacgcttgccaaagggggaggcagctgctcttccgccctttcttgaatcttctacttctgtgcttcaacctatcccttaaatgtacctggtgtagcaggctagtttgtcaggcaggtactttcattccagtttaatgacctagacagcctcctccctccaaaatatacatgcacatatctacccaaacccaattctttctctagaacgaagcttggcccatttaggacactttctctttgacgcttccagagaactttagaaaagttactatttgtgttccttctataatcattcccctgcctagggaatctctcttttgttatcttgaactataatgaagatgctttgtatctgcctttgagcatatttagaccgtgtccacaaatagattattgattccttttagggcaggctcttctttgcacccccacagttcctagcaaagacctgtgaggtaggtgtgtgtaaaccctcaaatgaagggggagcgtaagtgtgcatgcatgtgtgaattgtcctcactgtttctgtgccctctcttcatcagcacccgaatctctgtgcatctccacccatagcccagctttccagtgtgtgggactgtccttcagacattctcctgttgttgcaggatcgcagtaccctattttccgctgtgtgcacagaagcactcatgaagaggctcctgagagttactgtgactccagcatgaagccgacccccgaggaggagccctgcaacatcttcccttgcccagccttgtaagaaggcccctccatttaggtcgcctattaccgggtcacttcaggtcacttatgcacaggaccttaggaacagatataagtcagtctaaatctgagttagaaatacaagacttggaccatgcataaaatgcagtctgtttagcaggcacacctgtctttcaggatgaactcaggagctgatagcctttagcaagtcaacccacttctgggaagcccacccttgacaaagctggagcaattaggtttgagcctggtaaggaaaacaaaggaggaagcaaaaaacgagaagccagtgtagttggtgtcgtaggtgagctgttcacagagagaggataatgcaagtcacaaaaacatcagcctggagaggccaagaaaagtgtctcgggagaggtcttgaactgtttcggttttttggttttgtttttgtttttatggcagagtctagctctgttgcccaggccagattgcagtggcacgatctcagcaaactccgcctcctggattcaagcaattctcctgcatcagcctcccgagtagctgggactacaggtgcacattaccacgcctggctaatttttgtattttttgtagggacagggttttgccatgttggccaggctggtcttgaactcctgagcactaatggtctgcccacctcagcctcccaaagtgctgggattacgggcgtgagccactgcgcctggccttgaactggttattgaatgataaatgggacacttgaagaagaacaaggggaaagggccctaaaagggtcaaaacctaatttgcagagtaataaaaatataattctcatccaagtatatggtgagcatgggctgatgtctcatttaactaataacagagcagatgacagaggagggtttgcaaaactgatacgggaattgttaatgaaaaataatgctagaataagattcctaagttagtagcaaaaatgagttaatgatctacagtgtaataaaactaacctttggaggttttttttttaattagataaaaatcatttgtacgttttcagttttctataacttttcatagaatctgggccctaatcactggtaaatagcatgtcaagtgtcaggcaaatttatctgcctttacagagtcagatgacccttaggcagactttttctttttctttttcttttctttttttgagacagggtcctactccattgcccaggctggagtgcagtggcacaatcatggctcactgcagcctcaatctcccaggctcaagccatcccctgacctcagcctcccgagtagctgggactacaggcacacaccaccacacccagctaactttggtattttttgtagagacggggttttgccatgttgcccaggctggtctcgaactcctgggctcaagccatcctcccacctcagcttcccaaagtgctgggattacaggcgtgcgccactgtgcccagcctaggctgactttcaagcaatgctctagtaagaaactctacccatagtgattctgatgattctgtgtacgctgctgcgggctcacgctgacttcctgttgactgaaggttgtctctcactctcgctctctcattcctgaaccagctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcggtacgcaggcagggcagcccgctctgcagctccctctccagctcccaccacactttccagcctcccccaccaagacctgagatgggtaaccctgagttccacaggagggaacccgtcccgtgggggtctggacggctgtttttgcaaaccacaggatgtaccaatagttcaatagagttcagggtagtgtgtgccacccacagccaactttatgagtgagcccagggggagccctctgatactggcctcatctgctttgtgagtcatggtgaagtgaaggttggcaactgctggtagagccaactccttccaattttccctacccattttatagctgaaaagactgaggcctggaagaatagagtagtgtcagtcaaaattaaggctgttaaggcagaaataatttgataaaagatttattggaagccaatgtaaggatcagcccaagaagacacacgaacaacgttggacatgttccaaagtctgttacaagttgaaaggcttttagaagaaagtttaggagaggagacggggaccccttgaatcggagttgtctttttcattggagggtacagcacagaggttgcaatcactggctacagatgacgacatacaggctaaaatgttttaagtgcaagacagtcaataaaacttcatgagtcagaaataaatcagcaaaactttatgactcagaaacaaaccaaacaaaccagtgtcctcttcaatgtccacaggttacgtattaatcagtatgtcaacagtttgaagaattcacaataagatttgaggaactgacaataatattctttactctaaacaggatgtaagccatgaatcctaagaccttcttcccaggcaacttagaacatagtttattcttcaagggcagaggtgcatgacttaaccccttgcctgccatggcgttgggtcctgtttataatttggtatcttattgccacagagagtccattctgtcagtcttatgatttctcccttaacatcagtgctggtcggttgtgtctagactgcaaaacggaggtggtatgacagggtgtgtccaaccttccatcctgtcatggccaggaaatccatttttaaggtttctctgggggtctccttggccaagaggaggcccattcagtcagctgggaggcttaggattttatttttagtttacagtaggcgaggcatctaagaaggtcttgtagaaaagggttgtggagttttctagggctcagatccctgccccagctggtgacatgcatgacagagcctcagtctcatggggctgatcacaaaggctgcgggctccatactggcaattctctcccagagctgaagctgctggttcccctgacgtcagtgtgctgtgtttcagtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaagggtgagtgtgatggcgggcagagcgccggggaccgaggtctgccaggtgcctccaaaaccacacaaagatgagtcactagctcagaatcccaagactgatttctggctctggggggaaaaaaaaggcccagagaggaattatcgtaggctttctatccttatgtgaggactgagggtctccaaaggtgaggagggtgtatgcaaaacttgattgaattctccttagcactccatgtggtcactccataatactaggtgaagtgaatcattacatcccatcgttcatatgtcttgtaagtgcctggtgtctcatagacactcagcaatggcaggcccctctactgctttttgccaactcaaaacatcccacaccccgttccctccccagtagcctggcctcccatgggaagtctcaggtgtcaaagaataactcaaaggcatatatagtcaaccattagcccaccagttacctggatataagggaaaacagtcatatattaaattcatccatcaaaggcaaaaggaggatttatatgaaaaggggtttctgcagatggagtgatgttggttacacaacagcatgaatgcacctaatgccctggaggtgtgggcttaaaagtggttacgatggtcaatttcatgctatgtgtattctaccacaatcaaaaatgaagtttgagaaaagacactaaacaaattgtagaacataccttgggacagggagaagaaaagaggaaggagataaggaattgtgcttcctttcctggtgggatcggcgcattggcgggcatgggatggccagtcagagggtttgcccagggcagctgcacagctgtgagaggcaccaagtccagattctggattctctaggagatctagggagtttacctgggatgaggacatgattggctatctctgaccttggttagcggcctacctctcggatacactagttctgccccacttcccttgctagaatcccgtgcgtacacgttacctgtgaaccgcattaaagtgtaggtctgaggcagcaggtgtggggaggagccagggattctacatttattttctttcttttttttaatatttttatatttttaaatttttatttatttatttatttatttatttatttatttattttgagaccgggtctcattctattgcccgggctggagtgcagtggtgcaatctcagctcactgcagcctcgacctgctgggatcaagcaatcctcctgcctcagcaccccctgcccccctcccgccaacgtaggtgggactataggtgcgcgccaccaccccggctaattttttgtatttgtttgtggtttcaccatgttgcccaagctggtctcaaactcctgggctcaagtgatctgccacctcggcctcccgaagccctggaattgtaggcatgagccactgtgcctggccacagcctacatttctaataggttcccagggtctctgaggccactggtccaaggaccacactctgaataacaaggccataaaaaagacagaggagcccagccatgttcttggatcttaggagacacgatgcagcccatgagcccccaccccgtccccactcccagcatcatgagaacaacaaccatagtatctcagactcaaagaaggaccctttcacgcagtttggggatatcagcagacatgccccatacggccacattggctgactccaactggtcagtgtccattctgaccggtcaatggccaccatgcacctgttattgagtattttgaatatcacccctagaggtgttcacataggttttctctccctctgcggtgtaagatgccccttcattttgtccctctatcaccataacaatccacttccacagggagtgttatccagaaagagaggaaggacaaacctgcaaatgcagccttcactccacctccagagatggtcctggagattcttacctagcggctcatcttcttgtgtgttccccacacctcatggcatatggcccctgccccttaggcccacgatggccccagatggacagcccttggtgcaaatactgagcttccaagatgagcatctgactgtgcccccagtcccaggagcagacactaatttggccatctgggaggctctaaccaaagagaaacagatggagagtaagtgctgatctggccactgactcaagcttctgccctaaagctgagtccaggagagctcatcctagttcttcggtgtatccctattttccaagcctcccatcccaaacattagcgcatggtactgcggaaacagtgggggaaggtgtttgtgagctcagcctccttgccagcatgaggaatcctctgcagtgcccctgacataggtcacagctcttgcccaaaccctttatcagaaattcaccctgtgtccagacaattacatctatttcttgtacagctcaaggtgtcaagaggtctccttttacagttaaccaaagtgtttcttactaagtcccactgtcctttagaaaaggacagccctacagccattggggaaccccttccactttctccaggctaaaaatatctagtttcctcaactaatccttttgtgcttcagtttctgaactcattcgtgttctcagtaaacttgatggatttcctgtatcagcaaatggatgaaaagaatgatgctggactttcatttttatattggaatgattctttttcttaaaaatgttggcttttttctggttaaaaagtaacacagtattgttttaagaatatgagaaatttggaaaagtatgctccaaacctcttcaccaaaagaaaatttgagattaagctatacttcaagttttttcttctcatacatactttacctacatagctttttttcctcatacgtattttaaagatataaatgtatctttatatcataatgtatgtataatttggtcacctcttttcacttaattattataagcataaaatctttaaaacatgatttttattataataagctatagaactatataactgaaacaatctcctatttctaaatgtttgggattttctagtttttatttttatttttatttttatttttatttttgagaccaggtcttgctctgttgcccaggctggactgcagtggcacaatcatggctcactgaagccttgacctcctgggctctagtgatcctccctcctcagcctcctgagtagctgggattacagttataagcctccatacacgggtgatgttttactgtttaaaacagaatattttaaaagacttcagtaagtgttcttgtgcataaatctttatatgcacctcttcttatctctgtaaaatagtgggggcgtggaatcatgttaaattatgggaaaatattatgaatgctttttgaactcttaatacattttagctaattgttctccagaaagattatttcggtgtagtcttccaagcagcaactgagagcgcttttacagtcattttgttgccatgattctttagtttgtaaattccatgtctctacatttgccactctctgaaaaggcagggggcacagagcacaatacgtacagagaaaaaacaactctgtggggaaaatagctgcagtggttcattcctctgtgtgtctcccacatttatttagaacagtaaaaagctacatgtaaattttccaaagatttccactctacctatttcctctccaataatgacttgcagatttccccttaaagtaattttgctttgcatttcaacataagttcttgccgaatctagcttggcttaaaattataaatagagcaaagaatgagcactttattctattcagggaactctttcgttcgttttggaaaagatgttctaaatcatgcaagttgggtgctatggtgtaagtaaataatttttgccttatctaccctcagaatagatcatgaattctaaatgttcatgcttattttagagtagatgagtgggaagggagtactattgggtttaagaaacgcacattggctttggtatcatctccatgaccatcacttatttcgtatttgaccctgagccagctactgattcaccgagcttcagttttttcaactgtaacattgctgagtaaccgctgcagtaatatatttgaagctatgacctagatgaggttggcacagtgggaaggatttcctgtgggctgcttcattcttcttcagctgcgtgttaccaggggcctttgggccaccagttggtcttagaaaaggttcagcccctggaatgaccagcggatggcagtcttccacttttgaatagttgctttgtgtagaaaatggcctcgttaagctttagtctgaactatgaaattttttattactgggaataaacacgtgttgagcacctgttacatgccagtcatgaacgagacacagcttccgactcaataagctcaagagggagagaccaaagaaaattaaagttcgcaaacacttaagagtacagagtgtgtcttattgcccaatttaaaattaattaatctttacctaagtgaattgaggttgtaaccccagtctgaatcttctgttaaacttctagggacacaaagtttcttctggcttaatgactcaccttaaaaacatcttttcagctgcttgtacttgagagtgggccttatcagaagtaagcatcgttgacttttcagttctacaaatcaatgataggtttaagcccatgtgcaatttttaatcacaacaggaaaaaaacacttttagaaagtccaccagccttagtttggtaacacctaatttctaagaaagttttccaggaaaaaaatactgaatcatttaaattataagaaatgatgcataaagctgaagttcaagaatagtcattacagccttatagtcccttaggggccagttgggccaagtttaggatttaactgttgctggaatgagaaggcagtccccaccagagggttgcttaggaattccatgtgtttctgtgttttatcagcccagaagttcaattacgagtcatgtcctcttctgactagcaaagcagatttggtccttttaggaacatcctttaaggacagtgggtgggtgtggtttggagcctcacctggaaggttagtccccactccctggtagggacttctccttccccttgcttctgctgacaggcttcctggaccaggtcgtgagtggggagctcctttcatgtttacacttgttgggcttttcactgaaggtgttgtaataaaatgaaactcctctacaggcctcatccatgtgatgtcctcccattgggcactggcatggtccttcatattcttcttttaaattaggtatatggggatgtgaagacactttcccaaatgtatgtgcattacttggttttgaaagcagaaaattaagttagctagtcagatggaaattacttggaaacaagtagcctaagggttggaaacatgaagataactgaaattctgtttaccttttattcttttttttttttttttttttgagatggagtctcactctgtcacccaggctagagtacagtggcatgatttcggcttactgcatcactgcaacctccacctcccgggttcaagcgattcttctgtttcagcctcccaagtagctggaattacaggtgcacaccatcatgcccagttaatttttgtatttttagtagagatggggtttcactatgttggccaggctggtctcaaactcctgacctcaggtgatccacctgcctcagcctccgaaagtgctgggattacaggtgtgagccaccacacctggcctacattgtattctttacaagagtatttaaatgtcttgagttttaaagttaggaagaaaaccagatcatacatggctgaaacaaacaaacaaacaaacaaacaaacaaatcctttagcctagaatattccaattattgtaacaaattttaagctaaaggactgagtcattgtcccagatttctaatagcaatctagcaaaatagcaaaggacatgaaatatgcaaatagcaaaatagcaaaggacatgaaaaatgtctgcaaacctgtaggggaggaaaaatgtttcctctgcattcttaggttctctggctgcagtctgtgaattaagctgacaaaagattaacagataaaaagcataccaattttgtttgatgttaatatttttgtagtggcatggggggcttcataggaaagaagtgacaaccccagagaagcagttagacttgagggattatataccattttaacaaagggtgataaactatggagaagtgattagacaaaggaaaggggctggggcttctagggacagtaaattgtgagaaattgactaagaaaaatatgggggaaattgacagaagataagggtccttttattaaagtttatttgtgcagacttgtcttggagtcaactccccatctccagtgataagaatcttctcttcttcctagcactgggagggcacccttctcatgggaaatttatgccctggttttaggcagaaatggggaaggcagagagctcttcctgcatctgctatttctcaatagccttcagctcaaaataatcaacatgccaaagcaacatattttggggtggcatgttctgatccccttcaagccctttgctccagagggagtttcttccctaaggggtcaagcccagcttagcagtggaaaggtaaatgtttgatcgctcatgctggcatgtgattttacaagactagatgtcagcatacaaaaatgaaagtggaaattttgataaggaaatgaggttgtaaggattgtttttcccttttctcaatttttatttaaattctattgctttattttctaaaataatacgggtagaactcaaacattgactctatttttaagaaaagacccagaaacccttagaaagggctttggtcatgtgctaaagggccacgtctaggattagaaagtgctaatagataagagaaatgaacaaggcagggcccaagtctatatgcaactgatattcatggatttactcatgaataagacactgacctgagaaagaattagagatgattcgttagttcctgctctcaccaagcctgcttcagcaaagacaaaaaaaaaaaaaaaaaaaaaaaaaaagacaggacacaaataaccataatacaaaggcaggaagcagcacatagagtgccatgagaattccaaggcttgaaagaacatcttaaattggacactcaagatagtcttcacagaggacagaggagaaggtatttgaggtgagccttaaaggcttctgatctgtccagtgaagggaaagagcattctgggtggagggaatgacaggggcaagggctctgtgagccttttatgtgatcagggaataatagccactctgagtctgtccagaaggaggtatgggggataggataataggaaattagtctagaagaattgggtcaattggggccatattatagaaaacccttaatgctagaagtccatatgtgacttctgttaggaatgggataacttcagagggaatttttagcatggagttctcaacacctggcagcccaatgcattggaaaagctggtgaggttgagcaagaagctacagccacagtccagggtaagaaagtaaactgtgctgggaaccatggatggaaaggggcaagacaggttagagaaatgtggcagaactagagtctgtgagacctaatgattgtctagatgttggaagcaagagggtaggagaatagtcaacttttaaatccaggtagaaacttgaaagcaaatcagaaaaataaaaggaggaatggtaacggtggtgaaggtgtacatgctggattcaaggtatctgtaggacacccagataaggacgccccaaaaatgtttgaaaagataaagtttaggtgtggtggcacacacctgtaatcccagcactttgggaggccgaggcaggcggatctcttgcgctcaggagtttgagaccagcctgggcaacatggcaaaatcccgtctctacaaaaaaatacaaaaattagctggacatggtcgtgagcacctggagctactcaggaggctgaggtgggaggatcacttgaccccaagaggttgaagctgcagtgagctgagatcacgccacctgggtgatgcaatcctatctgggtgacaaagcgagaacctgtctcgaaaaaaagaaaagacacgataagatgagaaccaaaataagggcacattccaacgtatggcaagacagatggaaaatgctctatgagctttgggctgtgactcaggaatgttttcactgtatcctaggagaggacagtgtgattgtagtagaaaaatcactaatagatatttggctttaagtgaagattttatccctatgaggcttagtttctctatcttggagtgggaatgtaggggttgaagccccttataccatttactgggcacctcccatctgcaaagcacattatacagtctccatagccctgtcagaaatgtgtttctatgccagttgtctagatgagcatgccaaaggtaggaggggctgggtcacttgctccaggccgcacagctagtgaggatatcaacactgatgtacctggttccaaagccaagctctccctctataccaagctgtctcccaatcccctcatagctgtgaccttcagagactggaacaatttgccttaatatcaggcagcaacattgaggtgacagacttaagtccccctatttttccaacccagacttggctactagcaggtagaaatatgcccaggttttcatgcacccattcttcttcagctgaatatatatatatttttttatttttatttttagagacagggtcttctcactctgttgcccaggctggagtgcagtcgtgcagtcatagctcagtgtagcctcaacctcctgggctcaagcgatcctcccacttcagcctcccaaagctctggtaccacaggcgtgagccacaatacccggccaagctgaatatatttttgaaagcaaaagctgggaaggatagtctaacaagtataagtgtattaattgcagtggcaagattggatatttggaatttggaatgaagcccaacccagaaaatctaagacagagaattgccatactgatatctcataatggagtaggctatgcacgagaagctgccagatatttctaggggaaacagacggcaggaaaatgaagcattccatcctcctttccatcatttgaaagtggcttcagcagctgccagggcctcctgactaatgtgcccttcccctgtctcacagtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcaggtgagtggccagaactgggtatgtctgcctgtgtcaggcaaaaggcagcataccagaggggttaggaaccaggactttgtgtcaggtgtcccagctttgaatcccagcagtgccactgtctatctgtgaccctggagaagctatttatatttctggagcctcagtcagtcaacagtattcattgagcacctacggtgtgctcatctaagtacttgggttacatcagtgagcaacacaaatatctctgccctcagggggcttatggcctagcatgctttcctcatctatacaatgctggcagtgatggtaccttatgaggttatttttagaagaaatgaaattgtgtacataaagtatgtagcacagtgcctgacacaaaataaatggtggctgctgctattattcctgttaataaagccagtttttctgtatttgacagtatcagaagcagaaattttaaaagttggaattgttcattatgaagaataaataatactgaatactttaataattgatgaattacattttccctcactcttccaaaattgaacgtgaaccccactaagaaaatgtggaaatgactgccttggtttgattatcatcagtattggagttcttgagccacttagcatttggctcccagggctggctggttctccaaggactgtttggcttatgatcatgatttacacattatcaagacctctggctccatatagaattttatttcttttaagtagcattaaaaactgaccttggaaaaaaatgcactgccttatccttgtaaattgacacaagcccttgggaaagcaatttggcaataaaagtcaggaaccataaaaatgttcctttgccttaacccagtcaccccactcctggggattcattttaaggaaataattaacaaaagaaaaaaaacagcctttttcaacagagatgttcatgacagcaggatggttacagatattatggcatatcataactcagtaaaatataaggtgacaatgacagcgatcgttaggaagatgtgaaagtgcatgtggtataatggcaagtgagaaatagaatgtgaaaatattcaaaccctatcatctctgccacttcaatgtagagtttttatgcaaaaagcatagggaaatgtttttctattcaaattccctttaatgttttttaaaatatagagaattcagaaagaattcaagtacttccagtgctactctggtgaatatcaaagttagacacatttgctaactgatcccagcttgacttctcatgagttttctggctctaggtgagtgatttaacctctctgagcctgtttcctcatctgaatatgaaggtaatcatatcaacctcttaaggttgttacgaggttttcataagatgctatacataaagagaattacccattgcttgggatatgggaaacacttaataaatattggttcccatctctctatgtttattttttctgccagctatttctatctcattactggtagtaaaatacataggacctaaaccccaaagataattcagcagcgactgtatataggacaccaattataccaaatatccatagatgtgtgaaatcatatcagatcattacagtcacacacgtgaagataagcagtacaatcgaactcatatgtctaccattcttagaagagaagggagcaggattcagggccttttttgcttgtggcttcctattgactttagacctaagcttaaagaaccaagggtggtatgaaccctggcaaagacaacctttatttctgctaagattagaaacaaaggatttgttgccctgttgtccaaaagggtcaagatacaattgaatgtggccaagggttttggttctggatttataaggatgtcagggcctgctggaaattccctgccctaggaatttgacattatccccaaagaaaatgaaataagagcatgcttatttcttgaaaggtaagttttaaacattaactggcttcagaatataaaaataaatgttccttctcaccatatgggttgaatgaaagttggtatttcgaataccccaccagcctggtcacagtgattagtccaggagtagacatgtgatccaacaggtggatgtgtgacccaagctgagccacagaatccttcccaaggacatttcatttgtgttttagggaagagactcactaagaggttgtgagctcaagggctggcagtggccctactgaggcttgtgcaaaaagccagtctgagagaatgagacctaagtccatggagaggcagagaccaaggagtttctggctttagagtctttctgactccaccaagaaaggaatatattccatttctgctgcttcccagatccctggaaactaactaggagtatatcaagcttagggagtctttttctactctggaggcacagtagcccaactcttactcatgagagtctaccaagtctattatttatgcccagaattatttcctttcttctctatcaattctgagtttactgcaaccttagattgtcttagttccggggagatctgtcacagtctctagtcttcaggagcagccattttgtctgcctctgggtctggattgcattttattgattgcatttattgcaatagatatatttattctcatctcttcgcgaatcagtgatccacaaaagtgcaactgcaggaattctttaggtacagaaacatgcctaattgccatcacttctcactgaaagcatttatccctattaaatattactttttctcatgtgtgcttttctctgtggattacattttatctactatttgaattactccatcttgtttcttattgttgattttcacctgatgtatcttcatcaatttcttaattttcaaacgttctatgtatttttaaggtatgtctttcaggactatttttgtctttatttttacccaatctataaacctctgtattttaagagttaaattttaaccatttatatttattgtaatcacttatatgtttggacttttccctaccatcttattttgtgttttctattttcatgctttcttgcttctttcctctttcctttcaacatgcttgttattagtcaggttttcttaattccattttttcccctccaacattttggaagttataaatcttctagtggtatttcttctgtgataagattcaaatttttagcacagaattttaaacttttatgtctccattagtgtcaagttatcagtgaccacatcctctcctaaaagaaaatagaagccttccccttttatttacctccactctctcaatctacaatatctccaaaaagatgttgatattatctggatctagctccagattaatgttaattttatagaaaatatagatttaaattttaaaatagttttctgctttccccccaaagatttttttattgaaatataattcacgtaccataaaatttaccctttaaaaatatagaattcattggtttttagtaaattcacaaagttgtacaaccatattcagcattatccaattccagcacatttttatcattccaaaaagacacctggcatccattagtaataacggcttttattggtgtctttgccagctccttcttttatgtcctgtgtcttcttcctggttcttttttattttgctaaagactataacccaggaagtctttcaaataggatttgtaagtggtaaggtttctgagcccttgaatacctgaaaatgacttcattttgcactttgacacgaatgcttctggcagatgactcactgcttcctcttccttggcacagtcaggccagcccggctgctcttggccagtaactcagctgatcactcattgtcctgaggcctccatcctgatctccatgtccaccaccaatatagcctgaagcacatgagttttgctagagctcctcctctgtgtgcatttggactatagtttccttcttcaatttgatctcatctgtctttcattgttcaaagattccccataatttctggtccatcaaggctgattgccctttcttgtcttcaaatgctgtctcatgcgcgtgtgcaaacacacacacacacacacacacacacacagagatagagatacacacacatgaacacattcattcactttccagacgcacatattctgccatttctgagcatttacagtaagagaaggctgagacgggctcattctccctgaagtacacaatctcttcaaggacttgccaaaaatagcagaagataactacaagttttgatcaaagtttgcagtcttctgttctgccacacacttagtacagatgtaggatctcatagcattgaggggtctttcagattatgttttcaaacccctcactttctcttttcagataagaccacagcgacctgggaaagtgcaacgtcttagccaaagacacagaactatttagcgacactgtctagactctagtttccatgtctcctgacttcagtctagtgttccacccctgccgcccacccctgccccatcctcattcctcctgcaggagaggccagacctttgcctgctgcagcttgtggctcttctcctgccttcagttcttccattgcctgcagcacttgaaagaaaaggacaagacacgaatacactccaaatcataaactaacatggaagaaaataggagaaacagagtgggaaatcttatagtttttttttggctgggcacagtggctcacgcctataatcccagcactttgggaggccaaggcaggcagatcacttgaggtgtcaggagtttgagaccaccctggccaatatgacaaaaccccatctctactaaaaatacaaaaattagccaagcataggggctcacacctgtagtcccaactacttaggaggctgaggtaggagaattgcttgaacctgggaggcagaggttgcagtgagccgagattgcaccactgcactctagcctgggcaacagagcaagactccatctcaaaaaaaaaatttttttttagtaaaaaaatcccgtagttttttaatgctacgaagatggcaaaaaagaagacatagacaaagcagaaactgatggcctctgctatttcatgccctgtgtgactacttcatcatttgttggtttgggggttttataattttttttttctgtagatgcgtgtttttctttctctctatttttatttgattgtgtggctgcctatggacagcaaagctaatatttagagtttgaactgcagacattgttgcaggcttcttataaaggtagtcgattctttaaagtctataataaagtacatagaccacagctttacaactttaaatcaaaaagtattaagaggctgggcacagtggctcacgcctgtaatcccagaacgatgggaggccgaggcaggaggattggttgaggccaggagttcaagaccagcctgggcaatataatgagaccctgtctctaaaaacaaatttttttttttttaaacagagtcttgctcgtcacccaggctggagtgcagtggcacgatcttggctcactgcaacctctacctcccaggttccagtgattatcttgcctcagcctcctgaccccaggcgatttgctcaccttggcctcccaaagtgctaggattataggagtgagccaccgcgcctggcccccgtctctaaaaaaaattgttttaattagtcgggcaaggcctggcatggtggctcatgcctgtaatcccagcactttgagaggccgaggcaggcagatcatttgggttcaggagttcaagaccagcctgggcaacatggcaaaaccccatctctacaaaaaaatacaaaaattagccaggtgtggtgacatatgcctgtaattcccagctactctggaggctgaggtgggatgatcacttgagtctggggagtggaggttgcagtgagccaagatcactccgctgcactccagcctgggtgacagagtgagatcctgcctcaaaaaaaaaataaataaataaaagaacgaatgaaccaggcaaggcagtgcacacctgtggtcccagctactctggaggctgaggtgagaggaccacttgagctcaggaggttgaggccgcagtgagccatgatcacaccactacactccagcctgggtgacagagtgagaccttgtctcaaaaacaaggaaaaatattgagtaaaccaaacatgaacaaaaaacattttgcaaagtaatagatactaaatgggatgatttatcagcaaacagttgtatgcattttatttccataaactaatgaaatgaaccaacatatgtaattgcctggcttctttgtggggtcactaccccatggtgcagatttcagcaccacattaggaaacaagaagattgggctctgtagtcacagttcccgctggctgccctgttggaaggggagggttgaccatagggtacattttcccaagtcttaggtcttctcctcagctttgggtgttcacaggtgtgcagagtgtaggagttcattcagtcacagtatccacctcctaagagaataacagataagaatgtcagttcattgtcttgcctcctgtgagaggtgccagagtctatgggacagagacaaccaaatgacctggctggtgtgttcctgcaggagagtttatggtaaactgtttccctctcagcacagaagacaacaagatcttagtgactagcatcctccaggtatgacaatcagggcacctagtctgcatttggagacagaactgttaggaaactgcattccatatgccatttctcctccagaaacatttccaagttctcctgggttcttcctcctagaattggtggtagaattgacggtgcccgtcataagcatcccttgatggacagtagctgccaccccctttccatcatgtgacactcatctttttctgcttctttctgcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatggtaagtcatggtgctcttgatggaggttgcattggcacaacgtcccccacctgaactcctatagacccctctgggccaggcactgggttcagccctgaaagagattccctacagcaatctaccttaggtggtagctgctggagtaccccgtgactcagcctgcttcgtggggaaggcctgagacctagatgatcttgctttctaaactgtagaaacagtgactctcacacttcagtgtgcataggaatcatctgaggatcttgtttgacaagaccaactctgggccaactgtggccgaggatttgcatttttagcaagttcctgaggtgtgttggatggagttgtctttgtactgcattttgagcaatgctgccatagaggattgaggattcaagggtgctgttaaaagaactacatctgatgccaggcgtggtggttgacacctgtaatcccaatactttgggaggccaaggtgggaagatcacttgaggctaggagtttgacaccagccaggtcaactagcaagaacccatctctgaaaaacattttttttaattactacattacacaaacacacacgcacacactctctgtgtgtgtgtgtgtgtgtgtgtgtgtgtgtacactttttaaaaatcctatagacattctggattatggattgtgggactgattctgttttctgtttgaactggctactaggaagcgcaaagccaaaattatgcctcacctagtataccagatcctgcaaagtggattttatgtgctaatattcctgtggcttctctttctttttcctacttttatcttcctttagtactagttttctcacttttttaaaatcttgtggccctctaagtctttctcaagtcatttcaaatcctttttgtaaggagggaaatagtgtgtaaatgaagaaagagagagattgataaatacagaaataagttattaagaaatgaaaggggaaaggatggatatagtgataagattcatttttttcaagttgaagagttcattttcaagaaacttcctaaaacagaaaacctcctcaccatcattccaggtgaccagaaaacctcctgagggccccatcccaggtgaccattggcgtagttctgtgggttggggtgggaagtggaggaagggtcattctgcttctcatcactgaagatcttcaagcagaggctgtagtgagcccagagtaggggggccagagcctttctcacagtgatccaagggtgataaaagggaattttgcttagaaaatatatgaataaaagctgagaattccatttccaaaaagtgtctgtctgctctagtgataacagccatttggctgtgtagcaaaccacatctcagaggtagatgggaatgaaggaggtgggttgaaaggtttctggcaacttctgggaagtggaatttaattattttgatgttgaccaaggcttgaggatacaataacagatcgcagttttcttttgtcatctgatttggagagtctacaaagagccatgctcaccaggccaagttgaaggagacaaacttcaaaaacaccccaaatgtccgtcagcaggtgaacggacaaaccatggtgcatccacacagcggaacaaaaaactcagccacaaaaatatggatgaacttccggtgcgttttgctaagtaaaaaaaaaagccaggttcaaaaaactacgtgttgtatgagtccatctatataatattctgtaaaaggagcagctacaaacgccaaatcagtgcctgctggaggatggggtgaccacatctgtgcaatctgaccgtagaggggcagcatgggaattttttgtctgcaatgaaaatatttcgtgtcttgtttgcggtaggagatacacaactgtatgaatttgtcaaaactgatagatgtgtataccacaaaaagggacatttttagatgcaaatttagaaaatatgaagtaaatggttactataatagcaaagactgatggaagctagacttctttgaatgtaccttgttttacaaatttgagtttggaactaagtaaatattttagataatcataaaagaaaattaagttttaaaaaagcaatcccccagaactgaaaatacaatgaaacaaattaatgtaaatatgtttctagttggtggcatcagcactattgcaagtgacttgaatacatagtaatttgacattctatccctaaaaaaaattactgcagaagaatgttcacactgtttgcaattatcctatttttggtgatagtgttgtgctggatatgatgattgggcatataatgtgtgagaaggtaaatgagtaattagatgatagtataattctgttagccccaatatccttgagaagtaggatgttcaaacttaggagaaagtagatacagatacaagatagatattgtatggcttaagtccgcaataaaaagcctgttgtcctgaatttgaattggaagtgtcagtataaacttagaaattatctctctaaaaatcttttctaatttcacccactgaaagagtctagaatcagtgaccaatctcgggattcagagggggtggccgcttccagatctggggcagcatatatgtaagttaggttgggatatctttttctagcaggcagcaaggaagttcttaaacacaacagagctcatgtccaaagcatcccagagccaacttgtagaggctcctgtgagccattgagcatcagtaagaataataataccatagattagatgaaacacattatatgtgtttaaatccatccatttacaatgaagtttataatactttaaaaaactgataagtcatcatcataggatgttagggaaccaacttattattatgaaaacccgtaaatgaagggaaagattcaagtgtttatgctttctttcttaaacgacataccactgggtaaccaaagagtaaaggtgctgagggaatatgatagaattagaattagaattctaaactccctgtaaactgatggatctgagcattgcacatcagtggccactaacatccccaaaagagaggcagccccccggaagtagtctcacaaaaaaaaccaaaaaaaaaccctgcacctgttaaggcctcttttaggtccaacttccaatgttcaggagatatagagcatagaggaacacgaattacaccgtgggagcacagtcagcaaaatccagactatgggcaactgcagaacaaatgactcagttccaccccaccaccgcaaccaaaaactttttaagtgcaagaatgaaaaagacagtggaagggaaacctatggattgaaagagttgtgagagacttattgaccaattgcaacttgcagacctgacgcagatcctgattttttttttttttttttttttttgagacaaagtctcactcttgcccaggctggaatgcagtagcaccatctcggctcactgcaacctctgcctcccaggttcacgccattctcctgcctcagcctcccaagtagctgggactacaggtgcccaccaccatgcacggctaatttttttgtatttttagtagagacggggtttcaccatgttagccaggatggtctcgatcttctgacctcctcagcttctgacctgctctgcccgcctctgcctcccaaagtgctgggattgcagatgtgagccactgcgcccagcaatcctgatttttaaaggaaaaaaaatctgtattaaaaaatcttggctggctgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccagccgccccgtccgggagggaggtggggggtcagcccccctgcccggccagccgccccgtccgggagggaggtgggggggtcggccccccgcccggccagccgccccgtccgggagggaggtgggggggtcggccccccgcccggccagccgccccgtccgggagggaggtgggcggggggtcagcccctctgcccggccagccgccccgtccgggaggtgaggggcgcctctgcccggccgcccctactgggaagtgaggagcccctctgcccggccaaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggcggcagggtcctctgcctaggaaaaccagagacctttgttcacttgtttatctgctgaccttccctccactattgtcccatgaccctgccaaatccccctctgtgagaaacacccaagaattatcaataaaaaaaataaatttaaaaaaaaaaaaaaaaaaaaagaatggactttcccaggccagctgtggtggctcacgactgtaatcccagcactgtggcaggccaaggcgggcagatcacctgagatcaggagttcaagaccagcctgaccaacacggagaaaccccgtctctactaaaaataaaaaaaattagctgggcgtggtggtgcatgcctgtaatcccagctacttgggaggctgaggcaggagaattgcttgaacccaggaggcagaggttgttgtgagctgagattgcactattgcactccagcctgggcaacaagagggaaactccatcaaaaaaaaaaaaaaaaaaaaggactttctcaaagaaaatgtatttaaatgtctgcaccaataattccagcatgtgtatgaataaatatgatatgtcctttaaaaaaaaaaaaaaaaaaaaaatcttggctgggtgcagtggctcacgcctataatcccagcactttgggaggtcgaggtgggcagatcacctgaagtcaggagcttgagaccagcctaggcaacatggcgaaaccccgtctctactaaaaatacaaaacttagccaggtgtggtggcatgcacctgtaatcccagctactggggaggctgaggcagcagaattgcttgaacctgggaggtggaggttgcagcaagccgagatcacgccactgcactccagcctgggtgacagagcaagactccatctcaaaaaagaaaaaaatctataggattcgcaagataagtggaagtaggaacactgagtctatattgaagagaataagaaattattgtaatttctagggagaataatgatactgtggtaattgttaagagttcttgtcttttagagctacagcctgaagtatatggaagaagtgatcagatgtctagatttgcttcaaaatagtgggaggagcaggagggctggggatatggataggacacacctggcatgagttgctgattgttgaagctggttgataggtacatgggagtttgttttcatattctgtctccttttggaaatgtttgagattttccagtgtcttctttctccagtgtgctgagctattggtctgcccaaaaatctgatgttttccctttgttcccatgcagtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttggtaagtagagatttcaatcatgggggaaaggtttgtgttttttaagcttgtcagattctccggtgtgacaataacaagcctcttctaggtctttctgtgaccttgcacacagtcatggagttcagagggttgaggtgcttttggtattataaatttcatggtttaagatgatcattcatagcgaggatggctgtctaagccacccaccaagagacacactttagtgtggattgattaaaatggtaatgccttcaaagatttggctctatcgtccttaaggtcaaagtagtaaaatgtcaacttttaattgtaggtgcaaaccagtgtaggctggaccatgtggggagattctgggaccttagcagggagttggcagagaagggaggaaggggaggaggccaagaattggtagagacagtgatggagggtctgaccatctctcagaggggcgtagtgcaagctgagtccagagagatgcagtgactagactcaaggaggaggagtgacagcaggaagatctaggccacacaatggtcagagtcctgcaaagaacagcagtcttgcaattcagaagaccccaacctgcacccttgaaataggggccagtttcctggaggaaagcattggagagtgttagggaggttaggccctctcatgggctgcggttcatgaggaaggggcccatcccagcaggggagctcaagtacagccagaaaaccaaagaaggcacctcgcacatagattgggcagataggaagtgtgaggtgggtgaagatgcatctccagaggcatattggatgccccaaagcccaacttgaaatctactcagaatgcacccccaggtatagtcaggactggttccagaatggaggtgcaccgagccccttcagtagcttcttcacagtctgctaagaacatatttacttttctgtcttcacaataacatcaaaggaaatgtattaatatatcaataagctttcatggggtagattcctcctgctgtggaccaaattgaaggttttaatatactgacctaacatccttcctatcccagggaagatgtgtcagttacagcatagatgctttatgatcataagtttcctatgtcccagcaatgacccatgactaaagttatggggatgaccattcccagtagctaccaaaaaaacccataaattccataagaagaaaattaacaagtttataagatctatatagaaaaaataaataaaagtaagaaagccttgctatagaatataaagggaaatgtgaatagatagaaacattaacatgttcctgaatgggaacactcaatactataaaggtgataaaagaaggttcccaaggggagccgtatgtgccatatattggaacatattataaagctacagaaactaaaactattaggttggtgcaaaagtaattgtggtttttgccattattttcaaagctgcatttacttttgcacaaacctgatatatgatataggcataccatataccaacgttataatgcagaattctgaaacagactcctttataaaggaaagttaagtttgataaagggggaatgataagtaagtggggagaggagaggcttccattgtattgagaccacactgaagatccctttaaaaatataaaatatataaatgtctaatggattaaagactctaacagagaaaacagtctgtaaaaatgctagaaaaaagtatcttgggctggatgcaatggctcacacctgtaattccagcactttgggaggccaagatgggaggattgcttgagcccagcagttcaagaccagcctgggaaaccccatcttggcaaaaaacgcttaaaaattagctgggcatggtagggcatgcccatggtcccggctaattaggaagctgaggtaggaggatcacttgaactcaagaggtcaaggctgcagtgaggtgcaatcgcaccactgcactccagcctaggagacagagtgagaccatgtctcaaaaaaaaaaaaaaagaaaaagaaaaaagaaaagaaaaaaaagttatacacataaagctgcctgtttgtctcaggccagataatataactaaagacaatcaaaatcaccaggtccttggaattgattgtgtaattctcaaagctaggaatgactggcataagcaaatcaggtactctgaagagctgtcactcagctgcctcactatgtcaaaggcttctagctaatataatataatacaaaatgtgttgccactgtttttgtcttctgtatttgtctatggtatcttttcaagcaggggaaattgtctaacttctaattatataaaatccaactagagaaaaaaagggaaactatgagattaacaaaacagaatatgtagacaaagccttggtattctttgatgtgcctcaaaattatacctgtcaatgccaaagttactaaagatgtccaggccacaagccagagttatgacacacacttcggtatatcccagagggctgctgatagcaagaatctgtgtaggctctgaaggaaaagaaggctcaagtgcacattttgatgatgctgctgaagaagaaaatagtacctgagtacatgggtacatgtgtgctgttgtcagctttttgaaatctgcatataatctttcatttaatcccagagtgacatgattaaatcatcctacaattgatagcatcttaaaatcaaataaatgtcactcaagtagacagaaaattaaatccccaatatagacagaactcactcaattttttaaaaaagacaagtggtccagttttgtaaaggataaaggaaatgaacaaactcaccacagggccgggtgcggtggctcatacctgtagtcccagcacttcgggaggctgaaaccggtggatcacttgggccaggagtttgagaccagcctgggcaacatggtgaaatccttctctacaaaaaatataaaaattagccaggtgtggtggcgcatgcctatagtcccagctacttggaaggctgaggtgggagaatcacctgagcccaggaagtcgaggaagcagtgagccatgatcgcactactgcactccagcctgagtgacagagtgagactctgtctcaaaaaaaaaaaaaaaaactacaagaggctgaagaaatgctcaagctactagtaatcagaaatgcaaattttaaaaataatgggagtccatgtttttccataagattggcaagcttttaaaatattagacaatgtttgttcattgttggcaaccgcatgggggataggtcaagtggcaactcgtaacttggtgtaaactttttgaagagaattttatcaatatctatcaagatacaaagatattattacctttgacttaataatttcacttctaggaatatatactaaaaatatgctttcaaaaatgtacaggggcacacacatgcaaagaatagggctcatcgggtgtgccacctactcaggacgcagaggcaggaggatcacttgagcccaggaacccgaactgtggctgcccctatgaacagtcacggcacctcagcctgagcaacacagaaagaccccatctctgaaaaaaaaaaaaatagggcttaatgaattgtgtagaattaatgaatgaaccgtacaatttcttgtaacttataaaaattggaagcaagctgggcgacgtgactcacacctgtaatcccagcactttgggaggccaaggcaggcggatcatgaggtcaggatattgagaccagcctggctaacacagtgaaaccccatctctactaaaaatacataaaattagccaggcatggtggcacgtgcatgtagtcccagctactcaggaggctgaggcaggagaatcgcttgaacccgggaggcggaggttgcggtgagccgatatcatgccattgcactccagcctgcgcaacaagagcaaaactccatctcaaaaaaaaaaattagaagcaattacatttctataactagaaggaaatgacttatttaattatgttccagcacataggacaaaatacagacaccccaaaaaagaagatggtagatattatgatacaaaaaattatctaaatatatttatgagtaatattttaaaaagcaagcagctgagaagtatattgtcagttctttcccaaagtaatctataaatggaagcaatattaatcaaaatccaggcaaggtttttcatagaaaaatctgacaacctgtgtctaaagtttatgtggtggctcacgcctgtaatctcagcacttcgggaggccaaggcaggcagatcacttgagctggagtgggagaccagcctgggcaacatggtgaaaccctatctctactaaaaatacgaaaaaaattagccaagtgtggcagcatgtgcctgtaatcccagctactcgggaggctgaggcaggagaaaggcttggacccgggaggcagagattgcaatgagctgagatagagccactgtattccagcctgggtgatacagcgagactccgtctcaaaaaaaataaaataaataaaataaaataaatagaagtttatatggaagagcaaaagcaaggaaccaagaagagccaaggctgttttgatgattaaccatgttgagggacttttcctaccacatatcaaggcatcttggcacaaggatggataaaaaaagcaaggagagcagaataggccagaaatacacatataaaggatgtgtgatatatgatggaggtcatattatgaagctgtggggaaaagatgaacaattcaataaatggtcatgagacaattgtttatccatatacaaggaaaaaaacaagaaaactgaactccctcctctcatcctacacataccatacactccacaaaccctaattcctggtggattagtcaaaagaatgtgaaaagaacattttaaaacttttagaagagaacagggaaatttatattttatttcagagtacagaagggttttttaaatgaaaccaacaattccaaaccacaaaggaaaacatattataatatcaattacattaaaattaaaaatctctgtttatcaatcaacaccagaagcaaagtgatcagaaaagccacaggctgaagaagatatttgcagcacatataacctaactcacaaaggatcagatccattagatataaagaattttcgtgaatcattttttaaagttaactaaatcagaaaatgagcaaaagatcagaaaagcaattcacagaaaaggaagcttgaatggcaaatatacatgatatgttcagcctcacgtgggaatcatttcacattcactagctcagcaaaaactaaaacatatggcaaaaagagaattcttctgtttcactgacaggaacataaacagttataccgactttggagagcaaactgactgtatctagcaaagttggatataccttatgacccagcaaggcccaggcagaggatggtaacaaaactacttaaaagcattgtttgcactagaaaaaaaaaattggattaatgtccaacttaaatgtccatcaatagaaaatgattaaattgtggattatatacacaagaaaattcaataatgaaaatatagcattcatcaaatatgaatgaatcgcacaaattcaatgtcgagcaagttgccaaggagcttatacagtatgtatcttttatgtttaaatgtcacagagtggtgagggattccctcacatagagtttaagtgtaaagaaatgtttggggataagaaacgccaaatttggaacttctgattacctctggagtgatgaggatgaaggaggaagtgatcagagagaagtgaggacacagatgagtaacttattctctatacctatttcccttatcgtgtttaaaagaaagagaaaaacctgtgagcccttggcacacattcataccccacaatggtaataaacagcagcgcaggagttaaagccacagccactgccctttctcttcccactggtccaggctgcctcttgtgctcagggagtcttctgttcattctctttcgctacagatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccgaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttacccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccctctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaaggcactagggcacaaggagagctctcctaggaccaggaccaagaagctacaggcaggcacagtttagctcctgcagagacccagcttttcacaagttggagccttccagagatagagggactgtggtaggtggtgacccacccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatggggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatctgctttgttgacaagcgtgtgctttctctggccttattcacgttctgttctcctacaaatagccccctctaaaaataaaactcagacccttgagaggtcagccgcttgtagacgttggctttgggtgcttgaggtggagccgggccagttagagaatgagacacgccttagaaagaacatgagcccacccgtcctatgttaggctgcattagactcacctgagaagcttaaagtgaagtcgtcaggcgtgtgcaccgcgcccaggatgcaatctcacatgaatttctttatgtctcccccagggaattgtgcagaataggttggcagccactctgctggtttggtggggctccatctctaacttgaattaatcttcctccagctccctctagctgacttcacttggggcttgattttagcaaagtgttcgacaaaatctttcaggcgatcttggtgcaaaataaagtgaaacgcgactaagatggtgatgccagttgaagcccaccctggcctagagagcagtctctagcgaagcctgcaagctctgctacggactccgtcctggacagcatgtcgtcaataactcagaaaccagctctatgcctaaaatgctatcgcccacccttcccatccacctttttgcctggaaaaacctccattctttttttattgtggtaaaatccactttacataaaattcactattttaacttttttttttttttttttttttgacagagtctcactctgtagcccaagctggagtgcagtggcgtgatcttggctcactgcaacctctgcccccggggctcaagcgattctggtgcctcagcctcccaagtagctgggactacaggtgtgccccaccatgcccagctaatgttttgtattttagtagagacagggtttcaccatgttacccggggtggtctcaaattcctgagctcaagcaacccgcccccgtcagcctcccaaagtgctgggattacaggcgtgagccactgcgcctggcctccattttaaccatttccaaacgtacaactcactagtatttaaagcaaccacagtgttgggcaaccatcaccccaaaattccatttattcttcaacagttcaatacaggagtccaccaggcgccggccactctgctgagcacacttacatgagctcatttcgtcttcacagcaaacctatgaagttcaaatattgtttcctcctacagatgagaatattgagactaggagaggtttggtaccccagctgatacttggtggtgctaggatgccacagtcctcttcccctagaggctgaggcttgtctctttgccgcctccatctccccggggcctggcatgttatatggttccagcctatactagttccaacctctttctccacatcagtttcagtcactgggcaacaattgcacaaggactggttgaaaaagtccagcgctgcccatcctacccgggctcagtgtgaccaatgtgatctgaggcggcttctggaggagtgcaccccccaccagggggaggcagtgagcctgctctgcgcaaggggcagacccaggctgggaccctctgcctccagttccggggaccacatgtcataaggtttattgactgtctggaaaaagcccagaggatggtaggatggtgaccaggatggaggggttctggaaggagggctgtcttcaaccttcagacaatttaaagtactgtcagggacagatgacaagaacccggactcctccagcagaccagggcagggatgtgactgggagtcagacttggttcaaaatgagacgtttccagtaatcagagaggctgaacaatgggaaaagacactttaagagacagggccaggggcagtggctcatgcctgtaatcccagcactttgggaggccgaggtgggcagatcactcagaagttcgaaagtagcctcagcaacatggcaaaactccatctctacaaaaatacaaatacttagctgggtgtggtggtgcacacctgtaatcccagctactcagcaggcagaggtgggaggatcacttgagcctgggtggcagaggttacagtgagccgagatcgagccactgctgtccagcctgggtgacagagtgagatcctgtctcaaaaaaaaaagagagagagtgagtgagacccccaaaaaagtgatcaggaacattttaggagagggaaaatttgaatatgggctgtatttaagatgacatcattggccggacacagtggctcacgcctgtaatcccagcactttgggaggccaaggtgggtggattgcttgagcccaggagttcgagaccagcctgggcaacatggcaaaaccctgtctctactaaaaacacaaaaattagctggacctggtggcggacacctgtaatcccagctactctggaggctgaggcacgagaatcacttgaacctgggaggtggaggttgcagtgagcccagatcatgccactacactccagcctgggcgacaaaacaagactctgtctcaaaaaagaaaaaaaaatgacattgttgaatctgtgtaaagcttcttggacgtgaggatggtgtttggccaaacaggagtacatgttcctccagtacttagccaggaaggtcatgatctgctgtttaccttctaatgggtcactaaaagtgtgtgcgtgtgtgtgtgcacacacatgcacatgtgtgtatggagaaagcatgcacacagataaggtaagatgtattttggtgaatattagtgaagggtatgtggtgtccattacactacttctctgaggtttgaaatttcctaaaatagaaagttgtgggtggcagaaataaagtacaaaaaggggatggggagaaagagaactaacttttttcgctgtgtttttcagatttacctaataagaattaactggggtgctcattcaaccttgaaggtaagcaaggtaaattatgtgcacaaacaaatgtttttaattgtttgaatttttttcaatgaatcatttatcaattatggtttaagaagaatggctagctgagcatggtagctcatacccataaagaatcccagcactttaggaggctgaagggggaggatcacttgagcccaggagcttgagaccagcctgggcaacatagtgagaccctatatctaaaaaaaatgaaataacaattagccaggcgaagtggtgcattcctgtagccccagctactcaggaggcagttcaaggctgcagtgagctctgattgcaccactgcactccaggctgtgtgacaaagcaagaccctgtagaagaagatgaggaaaggaggaaaggaagaaaagaaggagaaggagaagaaagatgaaagaaagaagaaggaggaggggaggaggagggggggaggagggagaggaggggcaggaagaggggaggaggaggaggggaggagggtgaggaggacggacaggaggaggaggaaggggaggaggagtagggaaggaggaggcgggacgaagaggaggagaagaggaggaggaatggtcaatacttagtagactcaagtgcaatttaataaggcgccttacatcactttatcgggaacagttgccttggtctctctgaccaagaaaagagagagaagcgggtttacaaagtgctaggaaagaagacacaatattagaatgggttaacgaagcaaagaacaagccttccaaaagtggacagtggagccagtggagaggaggggaggtcccaggagaggggacaggaatctgtgtggtgatccttgccctcatcaaggctggggaaccctgactgggtgagcaccactcgatgtcaggtatcgtccgagtctctacagcacttagttttcatcttcgcaacaactcatgaagcaagcactcttgtgcggccattttatggacaaataaattgaggcccaaagagaataagtaatgtgaccaagctattaagtgggacagtctggcttaggtcttccttatgcctcactgtctaatgaaatcaactggaacttcttttaaaagtgatatgggggccctactcccagatattttgatcttcagttgattgagggtggggaccaggcatcgatgttttgaaacctctccagggaattctagctaaggctgaaaacactgagaagagtatgtcccactctgatgtgcatatgaattgcctggggatgttgttgaatttcggattctgatacagttagtctggggtggggactgagttctaacatgctcccaggtgatgctgatgctgctggtccaaggaccgcactgaaaagtgaggcacctcacccttcagaatgctgaggggtttcctatattcaccgggaagatgagcaggtgacctctgagtcatttgctttctttataaaacagtcttctatgaagtctagatgctaggtctgaatctactagttcaccttttggccaatgacgcttagggactctgaagtggttttaagcctctgtgctcctgcataggtgatttatttgtttttactagataattggtgtatttaggcactcagctgtccacacaaaagagaaaccttgactgcactgacttggggacttgtttttgttggtgggttttttgtttgtttgttttttgagacagagtctcactctgtcacccaggctggagtgcagtggcgcgatcttggctcaatgcaacctctgcctcccaggttcaagcgattcttgtgcctcagcctcccaagtagctgagattacaggtgcatgccaccatacccagttaatttttgtatttttagtagagacggagtttcaccatgttggccaggctggtcttgaactcctagcttcaggtgatctgcccgcctcggcctcccaaagtgctgagattacaggcgtgagccaccgcacctggccgggaagtccttctactaaaaatgcaaaacttagccaggcatggtggcatgcccctgtaatcccagctagtcgggaggctgaggtaggagaattgcatgaacccaggaggcagagactgcagtgagccaatattgcaccactgcactccagcctgggcgacagagcaagacctcatctcaaaatataaaaaaagaagttcagagggaggcagttgttggattaggtctgcaactcaacagcttcagggccagcttctctgcagctctcttggcctcttcttcatggttgcaagccagcttctcctgctccacctatcatgtccatcttcagggaagaaagcaggaagggccattgcagctgtgtatctccatttgccaataaaccaaatacattcccagagccccatcctacgtcccacaaacttctatttacatcttattggccaaagtgggctccatggccatttgtggctgcagaggaagctgggaagacagagaagggattgttatgcttggctgtgaccaattggggttccattagcagagaagaaagacaggaaggatgtgggtgagacaacctgggatgtctgattattgcacccttaccaagcaaaagcttctaggaagggacaacaaaagttcaaacaccgcagtgtctgttcatctttgacccactgaggaactactccttaaaatgggtttaggtcgtacatcctccctttattcagcaaatatttattgagcacacactctgtgccaagcaatgtttggggcaatggaaatacataaatctcatggaacttacaaaatgctgtgcaacctaaaacacttgcagataaggagacctattgcatcaggcttctggagcgaacagcctatgaatggacaccatatttggctctccatttgctgagagctggaacgggtgatgctacagattttatttctaaccagatagctagggaacttacacttaccgcgcctccacatgatcgacctcaccttgtatactcacagccacctcaacagctgggtgctgcaggtctctctgctttacagcggggaaaacaaagcctcagccaggtgagggaacttgctcgtgatcatgcaggtctcaagtgactggggactttgagcccaagtccgcctcatttcaaagcttatgctggttcctctgcatgctgcggcctttctgaaacaatcacacgaagccatcacgtagaagactaaactctctttaaaagtaaacttcagccagaactgacaccctgagcatggggcgttcatcacagcagatactgctgatgatcactgtggcttcatgaataagagcctggggacacaaggaaggcttctcctatgacacacacacatgcacaaacacatgcacacacacgtacacatgcacacgtacacgcattcatacacatgcacacactcatacacatacaagcatgcacacgcacacacatgcacacatgcactcatacacatgcacacacacgcactcatacacacatgcactcatacacacacatgcacactcatacacacacacacaaacacaaacactgttgcctgcagggaaaatgcttcaggagccacctctacttctacatcccacttttgtacgtggattccaaaaatctcttctaggcccaggaacagtcttgtttaaaggctggccaaggaggtgggggacagaaccagtgggacccaaagaatccagtgtgctggaacttgatgccgatgtcagcctcaatgctctcaccctgacagcagaagtggcggcttctccctccacctgtgcccggacagtgccaccagtctaacttctgccaccgtccctacctgcagctcacctgagcccagaaccatgccccctgcaccctcccgacacactcaggtaatgcccccgtttgtgttatctcttgctctataacaaacaaccattttattatttctcatgattcactgggtcaggaatgtggtcgggacactggtaatagctcattcttcctccacatgaagtccgccggggctgggccatccaggctggctggttcactcgcaggtctgatgatgatcaggctgagatgattggaatggtttgccaagggggcctcagttctctctgccgccctgttccctgcttcttcctctccatgtggtctcttcacgagggtttctctggatgaagaacaggcaagaggaaggaagagagagctgccagatctcttaggcctgggcttaagcacccttcctgcatgtggaacccctggcacgctaacctagggaaaggctcacacttctcactcactccactacccggcccacctcagtgacctcagaggggtctgccgagcctggggatgggcagtcgtccctgtccactccctgtcctggaggtacactggaaagccacaaataggcctttgtagcggcaagaggcagctgagaagcaccacggcaatgtagccgtcactcttggtgactccagctctttccatcctcggcccctccatccagatttgggtcctgcaagctgattctcaagtttggccccattgataagagccagaggcattgttgttttcttttcttttcttttcttttctttttttttgagacagtcttgctctgttgcccaggctggagtgcagtggcatgatcttgactcactgcaacctccacctcccagattcaagcaattctcttgccttagcctcccaagtagctgggattacaggcacctgccaccacgcccggctaaattttgtatttttagtacagacagggtttcaccatgttgaccaagctggtcttgaactcctgacctcaggtgatctgcctgccttggcctcccaaagtgctgggattacaggcatgagccaccacatccagccggcattgctgttttccttgtggcaattttaagtcaagtcaagactgattcagggtcttcctgttgatataagggtgtgaggaagatggttgtggcaggtgctatgagaggctgacctcataaaagttgtatgaatcattcagacaacactcctgccttgttatattggtcaaagccaaccataggcctgcccgcattcaagggaagggatatgagtctacctcagcctgctcctgactcagttctgtttgcctcagaactcagctactctcccttgggattcgctgcatcccaactgcctctatcctcctcagtcatggtaatcattcactcactcattcaatcgttcaacaaatattaattgagcatctaccctgtgcctgatactatgctaggcactgaatatatagcagtaaaccaggtggcataagactgtccccagggagcttccatcctaaagaaggagagagaaaataaagacataaatgaggacactctacgtggtgtgtcaggcatgatatgtgggctcatacctgtaattccagcactctgggaggccgaggtgggaggattgcttgagcccaagagtttgagactagccaggacaacataagaagaccttgtctctatgagaaaaaaaaaatagccaggcatggtggcacatgcctgtggtcccagctactcgggaagctgaggtgggaggatcgcttgagaccaggagatggagggtgcagtgagctatgaccttgctactgcacaccagccactccagcctggatgagatagtgagatgctgtctcaaaaacaaaaacaaagcaaagtagaaaacatggataaggagtggtagagacagggttggacctgcaatttgaaatagatggttagggggtgtggaacaagccagccacatggctatctggataagggtgtccctgttagggcagggaaatgtgcgaaagccctgagcagtggggcctgtgcagagggttcaagatgcgggaggacaaggcggagcaggggaagaggtatagtcagatgacgtggggcccaggggaaagacctggggttcagtctgagtgagattaccggccagtaagggatttgggcagaggagcaacaggattcgactaaggccagcagtctgatgtaagctgtggattcgtgcacctgctttgtgtgcaaatcacctattttcctgggtaaaaccattagcattagaggctagagccgtgaagctgagcataccctttcacttaataattccatgcctgggaattcaacctggagagagaatttaacaaaacagtattcttcaggagtctcaagttttcaataagaagtttttaaattttgtgtttttaacaataaccttttaaaataatggtgaacatatattccactgtctggttgattacttatatctcaataccacatttcattccagcagcagagttaagtagtattgctttaattgcaacaagctgagctaatgtgggaagaatgcagtagagtggcacagaagaatggtgagttcattgttattaccctcctagcccgtgagaacgcccaccatcccatgagttcctacatctatgccatgaggagcagttgggtttcagcacagcattctctatctttgcaaagttgttgattttaaccctgtgttttgaagttgtgctttgatttaattagcaatttcattttgatgggatagttatatcagtcataccccttctacttagttttatgtccataatattataattaaacattatttaattcaacattgaagggcagtgaaataattattttctgttttttctttttttctttttaattattatactttaagttttagggtacatgtgcacaatgtgcaggttagttacatatgtatacatgtgacatgctggtgcactgcacccactaactcgtcatctagcattaggtatatctcccaatgctatccctctcctctcccccgaccccacaacagtccccagactgtgatgttccccctcctgtgtccatgtgttcccattgttcagttcccacctatgagtgagaatatgcggtgtttggttttttgttcttgcgacagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtatctttatagcagcatgatttatagtcctttgggtatatacccagtaatgggatggctgggtcaaatggtatttctagttctagatccctgaggaatcgccacactgacttccacaatggttgaaccagtttatagtcccaccaacagtgtaaaagtgttcctatttctccacatcctctccagcacctgttgtttcctgactttttaatgattgccattctaactggtgtgagatggtatctcattgtggctttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatgtgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggcttttttttgccattgcttttggtgttttagacatgaagtccttgctcgtgcctatgtcctgaatggtaatgcctaggttttcttctagggtttttatggttttaggtctaacgtttaagtctttaatccatcttgaattgatttttgtataaggtgtaaggaagggatccagtttcagctttctacacatgcctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtaccagtaccatgctgttttggtgactgtagccttgtagtatagtttgaagtcaggtagcgtgacgcctccagctttgttcttttggcttaggattgacttggcgatgtgggctcttttttggttccatatgaactttaaagtagttttttccaattctgtgaagaaagtcgatggtagcttgatggggatggcattgaatctataaattaccttgggcggtatggccattttcatgatattgattcttcctatccatgagcatggaatgttcttccatttgtttgtatcctctttaatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtatgagaatgcttatgatttttgtacattgattttgtatcctgagactttgctgaagttgcttatcagcttaaggagattttgggttgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggtttttgaattttgtcaaaggccttttctgcatctattgagataatcatgtggtttttgtctttggttctgtttatatgctggattatatttattgatttgcatatattgaaccatcgttgcatcccagggatgaagcccacttgatcatggtggataagctttttgatgtgctgctggattcggtttgccagtattttattgaggatttttgcatcaatgttcatcaaggatattggtctaaaattctcttttttgtttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatccggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttttatttctgtgggatcggtggtgatatcccctttatcattttttattgtgtctgtttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttttctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcagattgttcagtttccatgtagttgagcagttttgagtgagtttcttaatcctgagttctagtttgattgcactgtggtctgagagatagtttgttataatttctgatcttttacatttgctgaggagagctttacttccaactacgtggtcaattttggaataggtgtggtgtggtgctgaaaaaaatgtatactgttgatttggggtggagagttctgtagatgtctattaggtccacttggtgcagagccgagttcaattcctgggtatccttgttgactttctgtctcattgatctgtctaatgttgacagtggggtgttaaagtctcccattattaatgtgtgggagtctaagtctctttgtagtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgaacctgtcatgatgatgttagctggttattttgcccattaattgatgcagtttcttcatagcatcgatggtctttacattttggcatgattttgcagtggctggtactggttgttcctttccatgtttagtgcttccttcaggagctcttttagggcaggcctggtggtgacaaaatctctcaacatttgcttgtctgtaaaggattttatttctccttcacttatgaagcttagtttggctggatatgaaattctgggttgaaaattcttttctttaagaatattgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattattttttctctaaacttcccttcttgcttcatttcattcatttcatcttccatcgctgataccctttcttccagttgatcacatcggctcctgaggcttctgcattcttcacgtagttctcgagccttggctttcagctccatcagctcctttaagcacttctctgtattggttattctagttatacattcgtctaaatttttttcagtttttaacttctttgcctttggtttgaatttcctcctgtagctcgtagtttgatcgtctgaagccttcttctctcaactcgtcaaagtcattctccgtccagctttgttccattgctggtgaggaactgcgatcctttggaggaggagaggtgctctgctttttagagtttccagtttttctgctctgttttttccccatctttttggttttatctacttttggtctttgatgatggtgatctccagatgcgtttttggtgtggatgtcctttctgtttgttagttttccttctaacgacaggaccctcagctgcaggtctgttggagtttgctagaggtccactccagaccctgtttgcctgggtatcagcagcggtgtctgcagaacagtggttttttgtgaaccgcgaatgctgctctctgatcgttcttctggaagttttgtctcagaggagtacccggccgtgtgaggtgtcagtctgcccctgctgggggggtgcttcccagttaggctgctcagggggtcaggggtcagggacccacttgaggaggcagtctgcccgttctcagatctccagctgcgtgctgggagaaccgctgctctcttcaaagctccgatggaaatgcagaaatcacccgtcttctgcgtcgctcacactgggagctgtagaccggagctgttactattcggccatcttccaattattttcttttaaaggtcgtctgagtgttactcgagtgtgcacacactggaataacgaatggtgtggagcatgggataattcaaaacaggctttcttgtgctccatccccagtcacccactcaggaagggctgaacgttcctggctgccacaagggtcagggaggccatgaaggtagcaaatagctagtcaggacctgtccaggccattcgtggtggtcaccaggcctcctccatgcacaggccctgacaggatggtccagccaggattcaggaatgttcagttcatttatgctggtggtgagcacaccgtcagggaacagcaggcagggctgtgtccaaaaaagttttctggctctcaggttccaggcatacactcactcactctttctttctttcactcttccttccttccttccttctctccttccttccctctttccctccctccatcccttccctccctttcttccctgcctcccttcctccctcccttccttcctttttttgttagagacagagtctcgctccgttgcccaggctggagtgcagcggcacaatcttggctcactgcaacctctgcctcccagattcaagcaattctgcctcagcctcctgagtaactgggactacaggcatgcaccaccacactcagctacttttttgtattttagtagagatggggtttcaccatgtttcccaggctggtctcaaactcctgagctcaggcaatccacccatctcagcctccaaaagtgctaagactataggtatgagccactgtgcccagcctccctccctccctttttttttttttttttttttttttgacagggcctcgctctgtcacccaggctgtagtacagtcacagctcactgcagccttgacctcccaggttcaagcaatactcctgcctcagcctcccaagtagctgagactacaggtgtgcaccaccacatcaggctaactagtattttttttgtagagacagggtctcactttgttgcccagggtggtctcaaactcctgagctcaagcaatcacctgcctcagcctccaaaagtgctgggattacaggcatgaaccaccatgccgagccatgcactctttttttttttttttttttttttttcgagatggagttttgctcttgtcacccaggctggagtgcagaggtgtgatcttgtctcactgcaacctccacctcccgggttcaagtgattctcccacttcagccttccatgtagctggaattacaggcgcccgccacccacgctcagctaatttttgtatttttagtagagatggggttttgccatgttggccagggtggtctcgaactcctgacctcaggtgatctgccaaccctggcctcccaaagtgctgggataacaggcatgagccaccgtgcccggccatgcactcttgatcatcactcacgctctctgccaggtgaccccagtcatcacctctgtaccacctcctccaagtacctttccagctcccctgactggcagggccatgagaagtcaacacccctcactcctccatgtcaccctgcctccattcctagtgtctgctgcttaagacacatccttcctgccggagccaagtttgcctaatcccggtgctttcatactttctttacctaccagcaaagtgtaacatgacagaggttcctagccaagcacatgcacagaatctcatctttctctggcgacacccttgtccatagtaggtttgccaggattcacctgacacttgctcccaggactgactcagtaaatgcccttcctgctcactgatctccaaatcctgggaatctgggccttgaggcaatcacttctagaatacaggaaaccaaattctagacaaagcatctgtctccagccattttccaatcatctcaacagttcctggccaggtgcagtggctcatacctgtaatcccagcactttgggaagccgcggcgggcagatcatgaggtcaggagatcgagaccatcctggccaacacggtgtaaccctgtctctactaaaaatacaaaaaaatagccaggcgtggtggcaggcgcctgtaatcccagctacttgagaggctgaggcaggagaattgcttgaacccgggaggtggaggttacagtgagcagagattgcaccattgcactccagcctgggcgacagagagagactctgtctcaaaaaaaaaaaaaaaatctcaacagttcctatgggaacatggaaaaccctctgtaggggacaccgtatattttaatgccaagtacgtgattcagtaaaataaatccagcatccactccactcaacatctgttttctgggtgtttgcgatatgtcaggagctctgacgcacatgagccagtgtatcaggacacaatggggtgatactcccagggggcggggatgccacctctgcgtcagatagtctcctgactgtcgctcagcccctctttggtgctttgatttaaaaaaaaaagttgtgcatgaaacgctatagggaaccgctggggttctttagtaagagcttaaatcctctgcctgaagatgcaagtgcgtattggtgaagtgtttactttgctacaattccaaagaagaaattctcaagtctcttaggctacaaattgggggatggaacagtgcagagcaggccaaacttttctcatggagtaacacctccatcttgtggcctttcagggtattccaagtggatccaactacctgctattttgtgattctgggtacaataaatcagatctgagagaacttgagaggtcctctgattcggtcctctgccttcacccagacgtgaagctccactattagctccatgatttcctcatagtaacagtccagagaggtgaagagacttggccgagcccacccagctaatacgcacggtctcatacctgaggctcaatgctacccacttgtcactctttaggaagagaaaaaaacttcttcaaacaaaatttgaccaactatgaaacagatgaaagcagagagagtcccggtagagactgcagaaggacccacccttcccagcaccttcagtcatcacgccctggaaaccactgtcttgtgccagggggatgctgcttctctgggtaatggaacatcattgtggcagcctggaaagccccctaggacaatagcattcccttccgagtagcttattgcttcaatcagtttaggtcctggccaggtaaatgccttttattaaaacacattttacacctctcatggcagaataaacggcctcataggataagggtgtgtggccccgcgactgctgatgagaagtgaagccagctggacttctgggtcaggtggggacttggagaacttttttgtcttacaagaggattgtaaaatgccccaatcagcacactataaaatggaccaatcagtactctgtaaaatggaccaatcagcacactgtaaaatggaccaaatcagtgctcagcaaaatggaccaatcagcagcacatgggcggggacaaattagggaataaaagctggccaccccagccagccctggtaaccagtgggagtccagtttggtgcagtggagtctttgttcattcgcttttcacagtaaatcttgctgctgctcactctttgggtctgtgccacctttaagagctttaacactcaccgggaaggtccgcagcttcattcttgaagccagcgagacaaagaacccaccggaaagaaccaactccgggcctccggacaccattgggacctgcaattgctgggacccggtcccgggaggatgcccgagagatgcccacagggccccgggcagggcagaaagccgaagccgccgcaggctgccaggactagggcaagcttacgtccactcaggcggtcaacaaataattatcagactccttctacgtgtcatgccgttgaacaagatcgacaagaccctggtctcacaaagcttctgtgcacattggaggagccgggtgactgcaaagaaagggcgtaagattgtttctgatagggcctgggatgtgaggagcgatgatagagtgcgtgctctcaggagagaccttggagctggtcttgaagtgtgaggaggagtcggttggagaaagagggaaagaacaggccgagccgagccagaaccgggtatagccagaagcgcgaaggagagagccagcactcgaggtcagaggaagcgcaaggtggcaccggcccctctcgctgcgctttttgtccttccaggagggggcgctggtccaccgactggcccggcagttccccagtagcaccgggggtttcctgccgcgcgcgtcacctggttcagtttagagcctccaaagctgcaaggcaaggcgaagatgggcagtggagacagagtagggtggggagggtccaagctgaggagcctgtagagcgtctaaagtcatcagtggcacctgttgtttcattgttcgtgtaggcagcttgtatgtgtatacatattttaaacttattacctaacatttcaatcacaaaagcaattagagataaaaggtccatgacacccatgtacccatcacccatatcaataactatcaccttcagtcctcagttcatctactccctcttttcattcattcgtttattaaaaaaaaacaacaacaaaaaaaaaaacagtctttaaaagcaaatccaagacattgactcacttctgtaaatacttcagagtatatctctagcaggattattttttaattaaacatatccacaataccattgtcataacaaactaataaccccttaatatattctaattgtatatattgtttttaaatattttatcttcaaaataattcgacttccacagaagtttttgttttgttttttgtttgtttgtttctgagacagagtcttgctctgttgcccaggctggagtgcaatggcatgattttggctcactgcaacctccgcctcctgggttaaagtgattctcctgcctcagcctcccgagtagctgggactacaggcgcctgcttatagacaaggataataatgacaatgcttatctgattgtgttgtcgtgaggattaaatgagtttacacatataaacgcttagaactgtgtctggcacataaaatttcttaataaatattttccattattattacagctcgtattttttaaaaattaacccgtctcttttaaaaagacaaaaaagctttattttatcttgattataattctaggccaagcacactgacttacgccctgtaatcccagcactttggagaccaacgcagaaggatcgcttgagcccaggggttcgagaccaacctgagcaacatagggagacccccatctctacaaaaaaattaaaaattagccgggtgtggtggcacacacctgtggtcccacctactcaggaggttgaggcagaaggattgcttgggcccagaaggtcgaggctgcagtgagccatgatcacgccacactgcaccccagcctgggtgacagaccgaaatcctgtctcaaaaaaaaaaaaaagaaaagaaaagaaaatgaaaaaagaatgcatactctgagcctgagagccagataactttttggacacagccctgactgctgttcctccatggtgtcctcaccaccagcataaatgaactggtcagtcagctagtgtaccctggtgtggttgtgcctgttgttaaacgtttaaaaatagttctatactggttttcaaatagcttcctgccccagcctgcccccagtgttctggcccctcccagggtctccagatctgcccatggcccagcaactaaagggtttacacctggtgcagcaggtggacgggcggcctctgcactgggggctgcagctgttccaagcagcggaggctcaggccagagcagccgctagagatttaggtcctcctcttgggtgaagagggagagaaaatgaaagcatggggagcttctcattttcacacataaagactgaatttctttataaatatttcctatcattattagtataggtaatattgatttcaaattagtctctttttttaaaatacaaagaactgtattttatccaggttagagctgtaatacatgtgtattattaaacattcaaatgaaacagaaatatttgcctgtggggagaatgtctgcggtggcctctggtgacagctctgcaacagaactgagacagccacctcgcatggtgcttgggagtcaagccaagctaacctggaggtctttcctgtcagtcatctcgggtacagaggaggaagaggtgacccagggtggagcaacagatggtgcatgttccagacaggctgctttttgtctgcctgtcccaggacagggcagggcccccgccagccctgcttagacctttagaagagttcaaggggaaaaagactttactagtcaagggctgggaaaactgtgcaggggaatatctgatcatttctaaatgttatcttgaaaagaaaagaaagaagctttattgagaaacattcccgctggtgtctgcctctcggagccctgcaccttccactccctgctctagaaagaaaaccattgattcatttaggtcctgccaaggagacaagcatcccatgatcttcagccagaaattcccctgggccacatgaaatcaaactatccatgtctgttttgtaagtggctttgaagttgagacattgtggacatatttccatgtaaatgaatataggaacaccaccagctgcaatggctgcatgggattccactgtacagagggagtagaacttatttagccagttgtctagaaaattgctgcagggtacatccatataattaaatctttgtaaaattttccaagggatagtttcctggagtgtggatggctgaggcctcagctccagggcctgtgcactccccactagctatgcttcaaagaaggtgaagacacttgggggtggggggcaggaattcggggggtgggcaggaatttgtgggggtgggtgactgtttaagaaataaatcctgggccaggcatggtgacagcactttgggaagctgaggcagaaggatcacttgagcccaggagttcgagaccagcctgggcaagacagggagaccccatctctatgaaaaactaaaaagttagccaggcatggtggtgtgcacctgtagtcccagctacttggaaggctgaggcgagaggatctcttgagcccaggagactgaggctgcagtgagctgtgatctcgccactgaactccagcttatgtgacagagcaagaccctgtctcaaaaagagaaagagagaaaaaaagaaaagaaggaaaaggaaggaaggaaagaaagaaaaaataaatcctggggccaggtgcagtggctcacgcctgtaatcctagcactttgggaggccgaggtgggtggatcacctgaggtcagaagttcaagaccagcctggccaagatggtgaaaccccatctctactaaaaatacaaaaattagccgggcatagtggcgggcgcctataatcccagcttctcgggacgctgaggcaggagaattgcttgaacccaggaggcagaggttgcagtgagccaagatcaccccactgcacttccagcctgggcgacagagcaagactccgtctcaaaaaaaataaaataaggaaaaaagagatcctggaagatttgttcccagcacccagtattgtggctgagacatgccccagacaagaagcccagagagccgctccccctagagaggctagaacaggggattccttgccagggccctgaggatgcagagggaggtcagtcctgctgcccctatcacgccttgttattccacccccaaccggcccagacctcctgggagtcagaggaagttgctgacctgtcccctgggggaataattgtattagtgataaggtggcctctggcagcttactcagcagattcagggctttgggctgagtaatcctttggcgtctgccccagcagctggtgatcacagatcggggagacccccccaacccccaggccctgctgggctttggcttccattcccccagcacagtgcatagggcacagctctggctggcctgacctgccaaagaacccagggccaggctcagaggggattttggctggcatccacgtgatggagtgacagaatacagtcaaaatcaacagcgtaaaaatgggccggtcaaacactgcagggggctttcatttagatgggactgggtttcttgtgtggcctggcttgttttgtttttgccattttaggtaatacatacccactacagaatacagggaaatacagacaaggttgaaaacagattctctgtccattaagtgccttgggatcctcatccccagctaacccgaaactctaagcctgttccctggaatcttccatctggatggaggagagaaagttgacctggagtgaggttcaatgtaaggacaagatctgcacccggagaagctctctctcggagagcacaggcggcctgaggagtcaaaacaggtggcctgtggagtcagcacaggcagcctggaggaggtgagccctggacaggcattcagggatgggaagggtctgggcagaaggagcaggagggccaaagccagccccgctcagcggcctcccctgcgtgtgctgcccctgagagaaggaagcgctctcctccagtagccctgcccccgcttcctcccttccatctgccctttccgcttcagttcacctcctttaatcccaccacaaccgcccaatgggacaccatcctactcattccagagagcatgaaactgagaggcagaataacttccccaagcccacacagccaggctctgagaggagcggtgctggcccaagcctgcccttaagcccgggctgcaggccggagcagccccttctctcctgccggctgccgccccctcaagcctgcaggtgtctctccggagatgctgggcatggggcagggtttgaggtacacccaccttccacctctcttcctggctctttctcctctgtagctcccattttaaaaggaactgcattcctaacatatttttctttaaatatctaaattcgttggggaaaaaaatctttccttaatgttaccctccctgccacccctcagccccgtctccttccctcacagccacgctccctccccacaactaggcctcctgaatcatgctccctcccagggcaccagctcctccggctgctgctgaaacccaatgaggcagctgcccctcctgggagggtgtcctggtgcaaagctgagtgcagtgccaagcacagtttgaaatcctcatctgcatccccagcctcctccaccactcactagctgtgtggcctgaagcaaattacttaacttctctgactctgtttttcctcacccatgagttgaggctagtaaggacagctcctttacaaggctgctgtgaggtttgaaggatctgtgtaagaacttggcatgcttcctttctgcatgacacggaaggaacacttgcatggtgacaccaccattgctgattcctccccgtccctggctcccgcgacagcgcagcgctgtcctgagtttccgtcttgtctctgatgtgcctttgtcatcagcttgtccttggctccagccaccagagtctgagacccttgagctcagccttaggcattttcaaacctgcacgcatttgctccaggcggccccccagtcctggggttactacctctgtgcagataaattgggggtggtttggtctggggcatgtggagctggactccacggtggaactgatatgaagtggccctggaagccgtgagtgtgtgtgaaactgcccgaggagagagcgggaagggctgctgggaccagtctctgggtacatggaggtgatgacaagttcaaggcaaagacccgtgttccagaagagatgggaaagagcggcttcgggaaggagggagtggccagtcaaatccatggaggatggcctcagcttcagtcttaggtggagctggagaccttgtcctgaggggctttttggcagaggaggcagggaggggtgaggacggaggagaggagaacaggtgagagcacccagcccggtggcctcgatcttctgaggccccagaaagcggattaccctgcaaagcccctcgagctgacttcccaaatccctaattgtgcttctctgtcacagggagggttaaccccacttacataagggccaggccccgccccctgtccccttaactccatgatccttctggaagcttcacgctccgcccgcttccccttggggtctaaggctggaccaaccccaccccagctcatcctgaggtgagctctggtctgctggggacaagtggtcccctccaggacaacatgggctttcagctctgtcccgggcagggagggggctggcaagtgggcctgggggtggaggagcaggcaagaaaaggctgctgagtgtgaccttctcagtaaccccaagaatataacaatatcagctgcacacaccatttattaggttcttactgagtaccaggctctgaaacacatttcctgaaccattgtctttagttccccaactacaccataggacaggtgctcttctcatcctgttttacaggtgaggaactgaagtttggacagattgagtcactttctcagggacacatggctggccggtgatggagaaggtacttgaacctgggtctgcctctgctctctccacactcccttgcgggggcccggggcttactataaggcaaggatgtaagacaagttcctccttccctctccttcccacaggagcagaggcatcgctgggctggaggtgggaaggatggacctgggagcagcgcagggggctggtgtggcaagaggcaggcggagctgtgaggccgagttcggggggaaggggaggactcctgagagcccgtggccaggctcaaggtggctgtgtcctcactggctctagtcctgcaggcctggctctccagaggagcctgccagctcctcttctgccccctcacaggcctgaaggagaccctccagatggggatccaggcctctttcctccaggccagcctcagaccctacgggggacggttctgggaacgtcctctgtgccaggtgtctggggactgctagccttctgggggggctggatcctcaaatcgtgagccccaagcagtccctttccaagggattggagtgagaacctcgtggggcagagccagatctacctaggacccaaggggagtgtctcaggcaggacccccacaggcaaagacacacacactggccacacacttgccttcggatgtgtgccaagcagctcaaaaggatttaaagtccagccaggtggggtggctcacacctgtaatcccagcactttgggaggctgaggtgggcagatcacttgaggtcatgagttcgagaccagcctggccaacatggcaaaaccccatctctactacaaatacaaaaaaaattagccgagcgtggtggcaggtgcctgtaatcccacctgattgggaggctgaggcaggataatcgcttgaacccaggaggcagaggctgcagtgagccgagaccatgctactgcactccagcctgggtggcacagcgagactccgtatcaaaacaaagaaaaagatttaaagtccttgggagaggtggagtccacacctctcttcaagatgtggcatgaaatggtgaacagctgagcacacagggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggtatggcttctcctggaggtagggttgggtctgggcccttggggagcagggtaagggccagaggttcgcagggaccatggaaggagccagaacaactcagacccagccccgccggctgtgggcaagggtggggtagcctgtgggtaaacccagaatcctagaaacacggtggggcggggatgggggttgggggcgggcaggctgcagagccaggacaggacagcctagccgatggggaaggaaagaacagagaagcgcccttagggcttaacagcacagaggtccctagtggcgttgacaagaatgtttctgtgggatgatggagcctgaagccacccacagagaagggatgggagctgggaaagtggagctagggctcggactcttgctgaaaattggccattgagggaggagagagggcaaggaatgggggtgggggctggggtgtggatgcacagtgagggagacacttctccagatggaagagtcacgcgtgggttcgttcaaatgcgggtgagcggggcctgaggactgggaaagggacccgagggaaggaggggagcgtgcagccctgccccggcccagccctgccctggcccagccctgccccctgcccctcaggcgtgagcccctcgctccagtgccgcgtgtgcggagacagcagcagcgggaagcactatggcatctatgcctgcaacggctgcagcggcttcttcaagaggagcgtacggcggaggctcatctacaggtgagtgcggtgggccctgctgggcgtctgcccctgaggggttctggaggggtgagggggtgctcaggggaagaggggcttgggcaaaaatgtccaagcccatggctcagggcatgggagggacactgacccctggggtctcctcttcacctgcaggtgccaggtgggggcagggatgtgccccgtggacaaggcccaccgcaaccagtgccaggcctgccggctgaagaagtgcctgcaggcggggatgaaccaggacggtgaggcgggggctggcccggggggaggtgacaagaaatgggcagcgggactggcgtgtcgtcctgacccttcctgcctccccagccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatggtgagtgggagagcagctgagggcacagcagggcttggcttcccgggtcacagcagggctgcagcgccttgccttgatcctccctcccccggggctccaagtactccctgccacctcccgagaagcaggcgctaagatcacaacctcctcctccaacagctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtacctaccggcctgcctgctggggagctaggctgggctggggtcaggcggcccactcgagtcaaccagacagggcacacacatccccacgccagtatgaatgcacacagcttggatggtgatggctggggacacacatacctctgattcagcgatggctggggtgcatctcagggatggtgacggtgggggtgcatgcatctctggcacagggatgatggtcggggtgcacacctaggagatgatgatggctagggacctacagggcccagggtcttcttaagttctggaagaccctcaggccctgcagacattctgtgggtaacaagtgacctgcacaccctgaacaggctgagtggctgactctaggcccccttggagcacaagtgcctacgacttcagggcttgcattttagttcaatctctccagctctgggccatccctctcggcttctaatgggcaagcagatctttcaggaaaaccaggaggagaggcatgaggagggtttgaggccctcagccagtctgtgtgctggggtggagcaactcagaagagtcaggccacaccacttgaatacactcaacttaggacactcatgaggcatgtctctgaggctgcccaacttccaatggctctgggcgttcctaaatgtcccagctgcagctctggatggaacccagtgtctcagatgataggcagctgagccggatggtgccaaatcccagagctctgagcctctggctgatgtcaggagagcattctcgggtcccaggacagcacttccattccttgggtgcctgagatggtggcagaggctccagactgagccagagaagctgtgtgtctgccataacaggcacccctgtctgagcacaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggacccccacggagtttgcctgcatgaaggccttggtcctcttcaagccaggtaactgagtctctgcccaaaccttgagtgggaattctggtgacttccatctgcctctcactctccctccactacccccatgtgtgcagatgtgtgtaggcctctatcctggggggtgggaggagagtggtgaggctggactcccttctccttggggccactcctggttgactgtgaggggacagggcaggctgggagcccctgggagaccctgagccccagccggagcccctggtggctcctctgggcctggcagagcccaccccacagggccccaggtccatgtctgcagccagaaccctgggccaccacttcatggccagccttataacagccgtaaacctgtgctaagctcactggtgctgcttctccccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttgggagaagacattgttaaaaatataaaaaggaaagccaggaggaaagacggttttgagggaagatgataaggtgttttgtaggtgcactgagcatcctgtagagatgccaagcacatggatggccctggctaggtttgggggagagttgctgcaggctgagtgtggctgcgcgagggtggggcaggagccggtgctctgggactacgctgtttggcccagcacaggcagatgtcatggagcctcagcaaggttggaacatttggccttcaggcatctactggctattttagaccatgttatctgcaatctttggggctcccggcagtttctttctgaagaagcaagctaatatgggcatccttgcatcacctctaatccaagaaatgattacaaggagaaaaggtaatttccttttaagaaaagccacagtatacaaagtatatgccatatagcacaggaagatttgtgctgcttatgagcatagggagaacgctgctactactaagacttgacttagcatctgaagagtgggattcagagacattcagaaaccagcagcctttctctgccaagtttctgttggaaccaactcccagagatgtcctggcatattggttatgcgtcaaatttcaaaatgctgattaagatttcctatgtcccttttatagcggttcattgcctactacaagggaattgagcatgaagatagtggtttggggttctctaatccagcatattatttcagtttttaaaaactgcaacacccaggaagaaacacaattaccatcgccccctgatatgcacacagacaccaaagcgaagttccacgaagtaattcctacccttagcttttacaatttacctgatgtttctcttttctttttttgaaaaggctgattgtgaccccctgaatttaatttcagacccactaggtgaggcaatacctgcagtttggaaaaaacattctttaactgactttatagttatttcttcttcctcccactctaatttagatcagaaaaacagaagcagggaaggcagatgggaggggtatacgacttgctcagtgctgctcacttggcactagcaagagaaaggaaggccttaggttggcaaagcaagtccagcagatcactgagtggtggggaagtcttccccgaaattcacggtgagaggagcatgggactgcccaatgtggagtagcctccttgatgctgggtgttgaccctggccatcagacctacccagggaaggtttagttcccccatctgtctcttggggcttcaccatccgtcttttgtgttgcggactcctgtcttagcaaatactttttttttttttttttttttgagacggagtctctctctgtcacccaggctggagcgcagtggcgtgatctcggttcactgcaagctccacctcctgggttcacgccattctcctgcctcagcctcccgagtagctgggactacaggcgcccaccaccacgcccggctaattttttgtatttttagtagagacggggtttcaccgcattagccaggatggtctcgatctcctgacctcgtgttccgcccgcctcggcctcccaaagtgctgggattacaggcgtgagccaccacgctcagccagcaaatagttcttatttaaaacaataaatatttttttcaatgactatctcagtcaccaaaattatccttcaacttcaggacattttcagtaatggctatcatcatcctaggtggtatacagacaggaatttgtattcttacaaacaattcttatctactaaaaactaatcatataattataatacttatatatgagattaataataatattttcatatacaggtgctccttgacttatgatggggttacatctggataaacccattgttaagttgaagctactgtaagttgaagatgaattttcatacataacccatcttaagtcaaggagcatactgaatgcttatcactttcacaccatgataaagtcgaaccatctgtatagagttaatataaacttcactttataatctttacatataataaacaatatttactcattattttcattgcactcctaaactaaatagagggtggcggctcacaatgggtcgaggtaggtggaggcaactcctctggttaatgcggcttttcttttttctttttttttttttttgagacggagtcttgctctgtagccgaggctggagtgcagtagcgggatctcggctcactgtaagctccgcctcccgggttcatgccattctcctgcctcagcctcccgagtagctgggactacaggtgcccgccaccacgcccggctaattttttgtatatttagtagagacggggtttcaccatgttagccaggatggtctcgatctcctgaccttgtgatccgcccgcctcagcctcccaaagtgctgggattacgggcgtgagccaccacgcctggcctgaatgtggcttttcctcgaaattcctcctgacccactctggggacctcatctctcctctccttcctcccctccctttcctgggagggcaccgccccagggactagtgctcagaagctggtcgtaaaactgatggcgtcctctctcctgttcaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaaaaatgagtgtggtcaaggctctccctttggggacactgaaggaatgagcgcaaggtctttgagttccatctgggttccactccaagtcagagaccaggcgcaatgaattcaagcccagtggaaaatctcccatagaattcaaccacccagcttctctccagatggcatcccatcatccgcagcatctctcaacctttatctcctatctcctgcctcatctccttcctaagtaaagaacaccttccaactcaacataaggcagctacaggtacgttttgtgaaagggactcttcatcacttctcaggtccttatggaaagatacagctcagacaaacttcatcattttctttttctcttttttctttttttgagactgagttttgctcttgttgcacaggttggagtgcaatggcgcaatcttggctcacgacaacctccgcctcccgggtataagtgattctcctgcctcggcctcccgagtagctgagattacaggtatgcaccaccatacccagctaattttgtattttcagtagagacggggtttctccatgttggccaggctggtctagagctcccgacctcaggtgatccacccaccttggcctcccaaagtgctgggattacaggtgtgaacctaatcctttttgaagatagacccagatgactgtgaaaataatattttaacatgttaacatagatcaggcaatgtatatattaatagcaggcagtgagccgggcactttttaaattgccatttaatccgcagattaactctgagggaagagccaattttctccatttataagtgaaaaaactgatgcttagagaggactcaaaccttggtgtgactctacctaatgctgcttaactttggcaccgcctctttcccaacttccccttcacttttggaatgaaagactgaacaattctgttgcattttctgccttcaaaggataagtgtttgaaatcaagacagaaagggtcatgtgagaaggctgagaaatcctaggggttccctgtcctttggcttgtgtttgaattcccttagctgacagaaatgccctatctactcaggaactcagaaccgctagggctggtgccagagaggaaagagtatggcaaatgctgcccagctgaagcccttcttacttcagcccctaggctacttcagattctctccaacttttcaaagtatcagagtggcctcagttaatcggtcaactaatgtctataatgccattatacagtccaattccctatcaaaagttttatccatatgagctaagccctgagcaaagccaccttagtaagacacatggttgaaatatgacatgaccagccctgcgtatgtatcttacagtttggctttggaggacatggtaagactgcaaaggtagcctgctgaagttcacaggctagcatctgggatgtgtgagcccagcacatctacattgggaaggagatttgagggctctccaagaagtcttggagaattagaggaagtacataagctggattgtctgctgtcaatcgggcatcaataccacccctcccccacttctaagggcttttcttcactgcagagatgccaggaaggaactacatttcccagaaaccctttcccctaggatttgctaatgaaagacactcacaggagattttttcccccctaatgccaaactgattaaatttggcattaggaaaaagagaagccatttttctttggagacactgcagccctgtcgtgggaaaatagatttcatagcagcctcctggctagaattgcactagcttccaggcaagctcttgagaactcctctggaacttgtagctgagatttgcgttggctttcttgacctgtgggaatatctctgacctttgttagatcctaatttctgtattaagtccatctcacctggaatacaaagtggcctctgttctcctaacctggtacagctctcagcatgtcttacagacaagaatacaaactcctgtttgtaaaccacctaggatgatggcagccattattcaacttcttgttgtagattggctctacagaaattctgatgagtaatggcttttccattgcatttagggtccttattaggagggtagataatttgaaagcttttttttttccccctcaatgccagaaatatctttggctatgaagcaccacagaggtagtccctgtgggactatctgggcctttcttttcaaataaagctagtttttagattcacgagacactcctctacccacaaggggatatttcaaggtaggaagggcagggaaagactcaaagatgccaagaagcgcaacctcatagtcaaacccaggtatcatggatgactagtctctatctggtggacatcactggtgttccccactagaatgcaggctccacagggcagagatctttgttttgttcactaatgtaccctaagcacctaggacaatgcctgtgggcactacctggaagtgacacactccttgactgtgagtctgagatacctacaagattcaacagtcagatattacatgtactttatctactttcatgtttatatctctggctctaagacactgtactgccacccattctaggggcaaaagcaatttaaaaaacaaaccaaaccaaagctgtggtcactttataacttgcctctccttatatacctttctgttctcaggtcttcataatcacaatagttgtcttctcagtaatcatctcaggggcaagttttaagaatgtatttcggctgggtgtggtggctcacacctgcaatcccagcactttgggaggccgaggcaggcagatcacctgaggtcaggagtttgagactagcctggccaacatggtgaaacaccgtctctactaaaaatacaaaaattagccaggcatggtggcaggcacctgtagtcccagctacttgggaggctgaggcaggagaatcacttgaacctgggaggtgggagttgcggtgagccgagattgtgccactgcactccagcctgggtgacagagtgagactccatctcaaaaaaataaaaataaataaaaatggtatttctaggttttatttgggcaactaagggaattttaaacaattaacacttcatatttcaatgtaatataaatttaatgcaaaaatgaaaatgtaaatgtaacgtaaaaacaagtgagaaggatgaccccagaattttaaaaattgaatacatttggcattagggacatgtttttttccccatgtaacctcagacctgatttggcattttggaaccactgatcctagtcaatcctctcatccaatatctgcctagccagcaccttttattaggtgctgggatctaagagtcagcaagacaggtaagtgtttgacgctgtgaaaactgagagctgttgagaacacagacctctaacccaattcacagggtcagagcaaacttcctaggacaactaccttttatactaaaacctgcgagtcagtaggagttctccaaagctgggagtttgggaaacagaactgacttccagataagaaaactaacattcagagagagcgaatgcctttcccagacatgcagtaaagttggtagcagaacaaaaatgacaaactgagttaaaatttctgttcctattgcaatgtgttgctttgaatttcagtgagaatccttgggccctctattggcaacctctattagcaacttcttcaagtggccaatttaggggaggatcctaaatgcagatttactgcttttcctcccttctagccttaaaccgattaaatgaagtcttgacagccagcagcctgcatccactacagaaaaaacgacaccttgaatcacaccttcacttgaattcagttgagttccagtgactaccacctctgtgctttgtcaactttgggttgagtcctttcctgaaaacacatcagtgtaactaagaagtcactgctgtttcttggagttgggttggaatagttggagtgggagccaggatggttggaaaacaaaccacacatattgctgcttctggaagctttgttctttaatgagccatggggtgatttgttcatcaagctgcttttgtgtagccatacagtgcatattttgagtgacacaaactgcactttatacagatggtatcttgttacccctcaaccccccagcaaagaaaaaaaaacaaaaaggaaattacaaagtgcctattgattgcatccggaatgtaatcagttccgtgggtgagataaatcattcttcttatagaattattctattaaacagtaaaatgttatatttcacaggatatgtccttttataatacagtttttaaaaaaaatttacactcagcatacttataaattacttaaaatccattaaaataatataatacgaatctgtagtccacacctttcccatagtaaatacaaatacttggttcaaaaggtgcaacttttatatgacctcagagggctgataaataggcattaagaatggatgactagcaaggtgacaggcccattgttggggcttttttgaaaatagtttcaaccaggggaccaacatgagacctaatagatccatctccacaatcatcattttgctgttaccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagtgctctggcaggtttccaaagcatgagaaggtgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaaggcctactaccctatgtaaacaacggctttccctcaaagggagggccccacactgctctccactcttatcattttgtggctctctcctcctcacccacccaccccaatcctggcagattaaattactagaaatccacaaatctagcaactgaaaaaacaagtttttttaattgaattttatccaaactggagtttcaggtccctgagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaatctctttttttcatacaggatttaaccaacattctggagcaagtgcagagtaacaattaatgcccagcagtacactactctcccaagaacactgaaacacagactgtgcaacctggcacggggctgaggaaccagcaatcccactctaacacaccatgctgaggggttttcctctatcctctaggagattctctgaaattcagatttttaaaagcttaacattatttattactcctcaggacaagatgaacaaggtggcagatgtctgtgggatataaagcataacatttgctcattaactatcattattctggagattttaatggcttcctttctctggctcaattctgaacccaaagtagggagaggtaagactcctgctacctttagctgccactcagaattatgctccaagtctaacctctggggctggccaataaccactgaggcagtggcgtgaggttcagtgttgtgtaacaggagagagagactctgccttaacaaaagacttaatatttccacaacttcaaagaagtatgaaaaggaagaatacccaaaatacaggttatagatggtaaaggctctttttcagagcagtgcatgtagtagcaagacaagatgcatttagtaactttaaaaataaacatttcacatacttatctcaagaaaggctatcatgtttcattttttatatattataaatagcaaaaacagatttctaatcccacaaatgctaagatacttaaaatgctattataactcatgtgtatgaagaccacccagtggtgaaaatgatgtcttactaattccctcaacccagggacgaatggctctcatccccctgtccagtggcccctcatctgtgggaagaaattccatgggaaggagggaagcacaaggttaaaaagaaatatgcctactatacatacatatttacaataaacttcagtaaccagaatattaacaaaaatagcttcaagtagtccttgatttttttccatctatttaatactgatagtctgagaaaaggaagataaaagttagttagttagataggtcatattaaaaacctttttattttttggcagctttctgtaacacttacttacttattcatgcaatattgtatgtgaatgtttttggaaactaactaaacggtcacattatttgtttgtttgtttgagtctgagtctgtggtgggaatccaccagcagatgaacaggctcatatgcggttttcggtttaatctatacaaagagaaaagcctgaatggcttaggatgaaaccttcataagtttagggatcaccatgtctctgggaaactaaaaaataatgtagaagaatctgatcctaggaccaagaaacatgagaacagtatggctactgacacttcagcccatgcaatgtatttggcaggaactaaacaggagttaaaccagcactgattactatgacatcaaacatcatcaaaaaaaataggtattctcttcttcactgtataacaagatatctgagacacgctctgatggcttaatggaaacaatcacggtttttttttgtttttttttttttgttttttttttttgtttttgctttccccagaatataacatggagtgttttttcagaaatcttaaaatagagggattaggctttttgtttgtaagtaagtttttggaaaaaaattatattctaccctagctcctaactatcccaaaataaacccaaaggcttttgctttcacggttaagaaagatttatacgttttcttcaaatgtcagaaatgagagggtccctcaggacagcaatatcccccctagttcaacacccacctttgggaagggaaaagagggtgggggagaggcaactacaactgacccaaatccccaggccctaggtggctttgtatagtaaaaatctcaattcaaatacaacagccaaggcacagctggcaccatccccagcaggctttctgcttctgcaggaggcccaggaattcagcacatacagtcttagccatatgcttagaaaagaggcaggaccacaattaggattgactattgtggacgaggtgatgaaacgcagccccaaaggtgagatttgtttaccactctgtagccacggagggacacacatctgccggttcagaccataaattcattatttccaaagagtgctagctgttggttggaggtgcagtctgggtccacagtttttctgcggccagacatgactgtcccctctggggtctctttggttttctgaggtgagtttttcacattctttaatttttgtttgcccttttccgggttgaaggttcctctgctgatgaactgaggcttgtcttccaggaatttggtctggcccaatggtccttccattcccagggcctcattacctgaggcagctcggtagaatggagatttggaataaatctgaaatagttttctggtcccatgagatgatgccgtgttagacagacataaagaggagaccgaagagtccacgacatctaaagagtcttgctgctttttaagttgctttcgcaacttgctggaaggttcagacttgccagctgtcttcagggagctaagggctaagcttctttctaatgcaaaaaagagaccaaagatgtaaatgacagtgccctctaaagcaaatcatcatataatgaatagatgccactgttcacacatgaaattgggtgggataagattcagagggtccaggatgacttactatgggcacagtcacagtaagagctcaccatccatttctctatgtagcatttccgaatcatctccaaggaaatctggtgtttgactatgccatcagcggaggcctagaacagtcactatcatttcaaaaactgccaggatatgcaggtaagtcctacatctccctgagacatgccacccagttaaacacctcctttgtatatgtatatagtcccacctcacagtgggggcacaatgcctgccaccctcagaaaatgggttatgggtcagtaagacaacatatattgtgattattggcttttctctgtggtaagtacaggataaaacattaaattaccaaaaaacaaaacaaaacaaaacaaaaaacaaaaaactcaatcacgttgaagagttggtttgataaacaatgtatatggaagctttacaaagacaacaggaaaaaaaagaccttccgtggaagtcaggaatctaagtagcaaagacaattatatttcttatccccttatatttcttatccccatccaggtcactacctgtatgccaaacgatgaaggctaaaattatatggataaaaggacaaaattcctcaagactttgttattgctgatgtacagtcagtaaattcttaaaagactttgtcttagttttggaatctttattcctcctttgcaaaacaaatctggagtctttggtctaccatgttcacttacctgatttctcagagatagcatattcagactccatattcaaattctctgagctatcagcagtcccaatggaggcctcagactcaagggtttcatcatcagaggcacggggttccagtacaagcatctcaaatgttagctcctccctgtaagacacaatcaagaaaccattagcatttgataggaagtggaaggaagataacagaaaaaaagatcctccatggaagtcaggaatctaagaagcaaagagagtccatttttactgtccccatccaggtggtgatgaggacctgtatgccaaatatggtgaaggctaaaactatatggactaaaggacaaaatgacagatagccaatctaggaccaataataggggtaagggtagggtgaagaaagatgtagtggtgagatctttcagtaaaatgaactctggactgataagcaggagatcagggctctaaccttgttcataatatccataatgcatcaggaaagtacctttctcttctggacctcagcttcctaccacaaaacaaagagattaaactagataacctctaagattccttccagctcttaaactattttccatgaagcttactaactggctatagacgataccctctatcttcaccacagagacctctagacgaagaaaaacactgattgatcttttctgtcctttgaagcttatgccatcttcagttgtcgtattctctagtctcccttcttcatcacggtcacccagctacctctcagtaatgccccacattctgtgaggtctttggtactcagatcctaatcttgctttttcactaatgcctgacatcacctgatctattcaattaatatctttgtaaaaactcatctgaatattctaacactgaagttcctttatgtctgcaacttctaacaatattctcctctactttatctaagctactttctccaatgcacagatcctggagcttgtcattactctgaatccaacactccaccctgttcacaacctccttatccttccaattcttactcaccttctaatcaagtctcttccctaacagagccccttacctttacttcccctttacctggcttgagatccatgaacaatcatttcaagaacagtatcaccagcattacaattgtctgaggccatgtgcattctgagactctgctcgttcttctttctttttctagagactctccccttccttgaaaattcctattaatccttcaagactgccaatatcatctgcatcaaagccaaactgggtcttcttttcagatcactcttctagcaaatagcccctggtcaatgtacatcatctttgccttatcatgttttttacagctgagccccagctgcttttttagctggcctatattccagaatcaatcatgagagaccaagaaagtattttaacagtcttatatccccttataaaccaaactcaagacctgggatcctggaactcaggaataaagatcccattaagacttcctaagagtcatcaatgtcgaccagaactattacacagcacctgtagggagaaccatggcacgttcatattatccccaaggcatactgtcacccaatccctgcaacagtgatgaatggaggtaaaagagcttctcatttgtctctctcctaaattgcaaccaatttccctatctagtatcctagcaccctctagggctatagccttactatgaccatctagttgctgttcccatggtcatatggatctttggctaataaccttccttcatggatttgtgaataatgcccattcttgaaagggactttggcttagcctaagaattccttctcttctttgcaaaataaatctgttcatggaggctggtctccgacctgttaggactccagtacctcatcttggctccccactgttactgctagatgaatcgtgactaagactgacatgccctgtggatactgtgtcctcctcccagtcagcctctacagaccatcactgtagcagcctcaggtttcccagctcatggaactggcttcccagagggaacaactctcacactgttacctgagtatagacaacacgtctttgtcatctcaacatctcctgtatcatctgacacagtgtttaacacacaggagataataaataagaaaaaataaagaaacgatagaaggaaggaaacaaaaacagactataactgtctctccccttcctcctggatactcacttctccttctgtaggttctcaatctgctcagtcagtactctctcctcctgctgcatagctgcttgctgctgttctgtgatgtcagtctccatggctgcctcactagtcaaggtctcctctgagacatcagacacagaaggcaaccgaactacaacaggagacgatggacctggatagtttcctcgacgaatacgcccctttccctgcagagaaaaattcatgttagaaagtaaattgagtgactgcatcagttttacattgctcttttaggataacaagtgtatttccatcacaccaggtgaatgataagaataaatggaaacactctgcgaggcctaggatatttagtgagacatattcatacaacacatttaagttaaaatatttcttgcaggagtactggaaaacggatactttggtaggtgggagtgtaagaacccattgtgtactgagatgagtttcttcttttaatataagctgcatccattccaaacaaaatagccacatctgggtatttatttttaaattaattaaaattgaactaacatttcagttctgcagtcacactagccacatttcaagtgctcaatagccacaagtagcttgtgacccccacactgactggtacagatctacatttcctaccatcatagtaagttctgatggataacagtgctctataactgtagccttggaatgcataatctctctaggaagaccatagaagtatgttctaaaactcagttttgaaaaacaaaaacaaaatgtagtcatttatagaacacagggtgctagtgagatatattttcttaggaaacttctatccttgagatcagagtgtgaaaatctcattgctgcttcttcctttttttttttttttttttttttttaaacattggttactttatatatgactttcttctggtagtggcaaactaaactttttaggttaatctcctgctaagaaacataaaaactcaacatatgctagaaggcactgaagagctaacaagatagattaaggagacactagtccagcatttagtgctgatctaaatgtcagaagtggctgtgactctaaacagagcttttgacatgctacagcagaggacggcaaactatagcccgtgtggcaaatctagccttgcacatattttgtaaatacaggttcactggaatacatttatctcattaatttattgtttattgctgcttttgcagaacaatggcagagttgattgttgagacagagattggcctacaaagactaaaatatttattctctagtcctttacagaaaaagtctgccatcaccttgggatagagaataaaagttggagccagacccactcaatggtgtgggttgctgcctggcaaaacctccgtgcctgacactgggatccccaaggtttgtttcttagacataagagtaaactgaaattataaaagtccttgcagatactgtagtctagcttcaagtcatctgaatggtccagaaaattctaatccctaaaaatgaattaatctcagattgctaatactttaggaccaggcagaaaaaaatgaaaacattcttggaagaaagtaacattatctaggcctcaaaatattttaaaaatagtttttcaaatactctgacaaataatcaaaggtaacaggcacaaaaggagacaggacaatgtaaatgaaaactagtaaaaatgacagaaaacagaaaccctaaaagactccagatattgtggctatcagatttaaaataaccatgctgaaggagacaggaagacatagctgaagtagtggactggaaattaggtcaaaagaaaaatcctgaaccaagcaggaagaaacaaaagaatggaaaaattcacaaaagaaagtaaaagaatggctgggcaccgtggctcatgcctgtaatcccagcacttcgggaggctgaggcaggcagatcacctgaggtcaggagttcaagaccagcctggccaatatgaagaaaccccatttccactgaaaatacaaaaattagctcggtgtggtggcatgcgcctgtagtcccagtactcaggatgctgaggtaagagcattgcttgaactcgagaggcagaggttgcagtgagccaagattacgccactgcactccagcctgggcaaatatcaggacaagagagagatcctatagaataaatattgaagagatcatggcagagaattttttaaaagcagttaaagatattaacctaggaatttaagaaagcctacaacccctaagaaagaaataaaaagaagtctatacctagacaaactactgttaaaaactaaaggcctaaggcaaaaaaaagacttaaaagcgttacaaaaagcaaattccttgcaaaaaaggaataactattagattcaaagtttatttctcaacagaaataatggaatgcagaaaacaatggaatattttcatggtgatgaaaaagtaactgccaagcttgattgttatatacagaaaataattttcaggaatgaaggtgaaataaagacatttcagacagactaagaggagaatctcacaccagcagacctgcactaaaggaaatattgaaggaaagattgaaaatgtctcgaagaaaagttagaggtgtgagaaataatgaaaggcaatgaaacgtgagtatgtttaaatagtgactgcataaaacataatagcgatgtgttgaatttaaaacatacagataattaagatacacaacaacaagaggaacaaaatcatatcacagtaaggcatattaaaacacctgtattatctgggaaaaagataaaactactagttagcaaatactgatagatcacagatctgttttcaccatttggttaatgactaaaataatagtaaaagagtaaaacttccaaacaaaagaaaaaatggaataaaaaagtagtaaaaaaatgcaagaaagagcaaaaaaggcaaggaagaaaagaaaaaggaacatatatcaggcaggacaaataaaaagcacataaaaaacagtagattttaagcccaaatatattggtgagtatattaaatataaatagatgaaatgctcctattaaaatttgaagattgttgggccatataaaaaaaaagaaaacctatctatatgatgtttataagagacatgtgaattcagaaaggctgagagtaaagaaatgggaaaaaaaagacataccatgcaaataccaaaataaagctagtacagctatattaactgtaaacaaagtaaactttaagaagtattacctgtgataaagagggatacctcacaatgacaaaggttcatattatgaagaataacatttccaaatatgtatgtacctaagaaattgcttcaaaaaatttaaagtaaaatattgacaaaactatttttaaaaaatagactataatcagtactgagagaacaagtatgcacacgcaatcagaaatgatgtaaaactgaacttgatataagcaatctaacagacatatacagacttcagtatctaactagagaatactcattttaaagcgcacacagcaagacaacaaaattccaagggttgaaataatttatctgaccgttaaagtaatttaaaacaagttttctaataatgtagttacaaagagaaaattaaaaattcttgtatactcagaaattaagaaatagactttaaaacaaaccatggtcaaagaggaaatcacaatggaaattagaaaatattttgaatgaaacaatataaaaacccatgtaagctctgtctactttaaagttacagccttaaatacatacattagaaaagaattaattaattaaagaattaattaattaaggatgtaagactctatttcaggaaactaaagaacaacataataaattccccctgcaacaaaagcaataaagaaaagagcaaacaaacattagaataaagacaatcaaagccaaatgtagctctttgaagaggctaataaaatttttaaaaccctagcaagactaaaagaagtcacaaataaccaaaggttgtaatgaaaaaggggatatcactacaaatcctgtagacccaaagaggataagagactactaaaaacaacttcatgtcaataaatataaaattttagacaaagtggagaaatttctatgaaaatctaattaataccatcaatgaagaaattaggaatgtgaataatattaaagaaattgaatccagagtcaaaatctttccaaaaacaaaactctaggcctagatttcagtggcaaagaagaagaaataacaaattcttccacagaattaaaaaagaaactattccctaacttgtctttagaggcaggcgttaagtttgataacaaaacacaacaaatacattaaaaagaaggattattgccaggtgcagtagtgcatgcccacaatcccagaactttgggaggctgaggcaggtggatcgcttgagctcaggagtttgagaccagccttggcaacatggcaaaaccccttctctaaaaaaaaaaaaatacaaaaattagccaggtgtggtggcacgtgcctgtagttccacctacatgaagcactgaggcgggagcccaggaggttgaggctgcagtgagccaagatcatgccactgcactgcagcctgggtgataacagtgagagcctgtctcaaaacaaacaaacaaacaaaaacaaaaaaggattattatgggttaactttactcataaacacatgcaaaaatcctaaacaatatcctaactacaacggaatcaagtaatatagaaaatgtaatataaaaattttaaatatatgaaaagttggatttattgtagtagtatgatactactacatacacataatataatgatactactacattataatgtagtagtctaatgtagtccattagaaatggactcagtgtaatgtgtcatatcaatgcaataaaaaagtctgataaaacctcaatacatgcagtaaaggcatttcataaaattcaacattctgtcacaataacaactcttagaaaacctggaatggaaggacacatgcttaatctcataaagtacctacaaaaattctatagcaaacatcacacttggtggtaaaaggttgaaagcttttcctttggggctgggaacatgccagtaatgatcactatcaccacttccattcaacactatactggaggttctaacttacataagaaaaagaaagaaaaggtataaggattacaaaagagcaaatgaaactatcattattcatgaatgatatgactgtacaggtagaaaatccaaaggagtccacagaaaacttattagaataagtgaattcagcaaagtcactgaatacaagatgaaaaataccaaaatcaattgtatttttatacaataagcaacagaaaataaaaattttaaaataatacctatgattgcatttaaatattaaatacctagtagtaattcaaactaaagatgtgtaaaatctcaacgtacaaaactataaaacacttttgagagtagctaatgatctacatgaatgaagagatatatcatgttcacagatgggaaaaatcagtatcgtaaaaatgtcagttctccagaaggcaatctatagatccaatgcaatcccaataaaaatcccaagagaattttttgaggctgatttcataatttatatggcatataaagagccaagaatagtcaaaacaccactgaagaaggtaggatgacttattctaccagttatttttagaaagctagggtaaataaaatagtggtggtgttggtacaaagatagtcaaaacagagcacctagaaacagacccacacataagaaggctcccaatttataataaaaggggaactgcagggcattgtggaaaggaaaaattttcttaaacatgactttaaaaggtattcatcctaaagggaaagactgattaacaacattaaaatccagaacctgtgttcatcaaaaaagaaaggaaaaaagcaaaccatagaatggaagaaaatttgcaacaaaagtaacaataaaggatttgtatctggaattcataaagaatccctacagaacatcagaaaaagacagacaatccaattagaaaaacaggcaagagctttgaacaggctcctcacaaaagaggatacagaaatggccaacatgtatatatacacacacattatacatgttagagtcacaacaaaaaatacaatttttaaaaataacacacccatcagaatagctaaaattaaggaatctggcaaaagaagtgctggaaggaggtggagcaattgggaattcctacacattgctaacatattaacaaccattttggaagaaagtttggcattatctactaaagctgaagacacatatatcctgtgaccctgcaaatccactcctgtatatttctccaacaaaaatacatgtatgagtccattaaaatcataattccccaaaacacaacccaaatgtccatcaacagtagactaaattgtggtataatgcatacactgataaactatacagttatgaaaatgagctacaacaaaatatgaataagtcttacacacataaggttgactgaaatgaatcagagacaaaataatacatcttagatgataccatttatataaagctcaaagttaggtaaagcaaaactacagtgctcagggatacatattttggtagcaaacaaaaaataaagtaagtcattaatgtaaaaatcaggttactgcttacctttggaggagaaagaggattgtgactagaaagggaaagaggagagcttctggggatgctggcaatgtcctatttcttgagctggggtggtatgtggatgttcatttataataattccttaaactgaatatgtttctgtgttttgtatgtgttttgttgttatgtatgtgttgtattttgcaataaaaaagatatttaagagttccttttcaaagttagctatttatggaaatatacgaatagcctttgaaaattatgtgactttaaactgacaaatttctgagttgagtttggcaagaaagaaaggaaaagtgctgtctcaaaaatagaaatccatgatctagggcaggtgatagggtaaaggctggagggtagttctaagggcattcaggctaactcctccaaaactaaaacacttaatgggataaaatcaggaggattacaatattgctattccacttttagttctaaaatcaacaaggaaaaaacatgttaagaaaaacaagctaaaaacagaagatcactctgcaaatttaacaaaaaatgacaaagtattctttatgttataaattccaggacatcatccagttccatttgacattgactatttctagccaaatgaataaataatatgatttaaaagcctcaaggagcttgaaaatctgagtttattcctagtgtccacattccagtattcaataaaagagctgccttttttcagtgttcataccatcagctggccaccggagtatttcaccatgagttagctgcaaatcttttaatatggctaaagaaaatcaaacaagctcaacagatctgatctcttttaagaagcattaaacaaaacaaagaaaaatggaaactcctacagcctagaattatcttaaaaagattaaagtaatttttaaaaagttgattacatggagcttttagaaacatgagaaaatactaatattgtgttaaaaacagtacataaggttgtataccattggttttaaaaatgagtaatacaaaatttgcaaatacactaaattattaacagtagtttcctgactggaataatatccttcactttcccactttcctaaaataagcatgaatttacttttttcaaactggaattttttcttttggatccatgttcactgtatattctcttgtagtgtttttttccataattgtttttctaccaccagtgtgtcacagagtgaaaaaggcaaatattttcttgacagtatcataaaaataaatttgaccttgtagacctccctgaaaaggatctgtagataacactgagaagtggtttatagtatcctttgttcatttttcactgggtagctaatctttctatttacttataggagcttctctttattaaggaaaattagactttgaaataggaattgaaaatattttcttatggtacgtcacttcccttttactttccttatggtcatttttgtcacacaataatacctggtttttgttgctgaacctttcaacttttttctttaatggtcttatataatagcaaagccctgtccaagattatatttttccatcataatagggattgtattggttttgactgatcacagactacatgaataatttgtacccaactcttaatgcaagtactggaaaaaatataaagccatattgtcatcctttttctcagtaactattccagtgacttcctggcttaaactttgcaggcaaactgttcctaaaatgagaatatcaaatacaattatcttgaactgttgataagtagtaggtctcaagtcctactaaatcacaatttaatattatatacaatacccagatttccaatcctttatagcacattaacaggattatcagaaaaatctggactggactaccactaccaaagacatcacagataatatgcttttgacagagagccaagatcaggaagcagtttaagacattattaggcttatagagagctaactattctcagtttgtacagaaaaataaactagcactgaattcattcctttcaagtgggaggaagtggagttctcttcttaaaagctgtgttttcagagctctaaaaaggtacacttataaaataatttaaaaattcttctgaattgtacaatgagatactgggacccctgacttaataagagatctttaatcacacttaagcttctttctggcttgttttcagtttctgttttatgaagataaatgttttttggttaatctctttccatttgctccccttttccctttttatttgcacttttttcaccctaaagatgtatcctcttcagccaccttttatggcttggtttcaacttttgcatgaaaaggtttagctgataactttgctgatttccccttgtgctccttcccgattgccctttgagctgagttaaactacttggatattttggcagtattaaggtagagaggtagggtacttgagttctacaggatgcagggcagtgagaacctctgccaggatggagtgccagagctgtacttccagtacttttatgttttagtctttgatgtgaatcaggttttttttttctttctttctttctttaaagatacagggtcttactcttgctcagcctagagtgcagtggcacaatcatagctcactgcagccttgaactcctgggctcaagggatccttctacctcagtgtccccaattcgtcggactataggcatgtaccaccatgcccagctaactttttaaattttttgtagagatgatatctcgcattgttgccacggctggtctgaaactcctggcttcaagcaatcctcctgccttggccttccaaagtgctgggattataggcatgaactactgtgcctggcctgaatcggctttttttttgtttcttttcttccctacatggatattcattttccccacatcatttagtgaatcccagacctttgaaatgccactcacattataatcctttatttttctcttttagaattttcctattctgcttctttattttcttatgaattttagtatcaacttgtaaagatccccaaagtattcttttgctgtttttgttgagacctcatttgtaagtagttatgaaactctttccttgtctgtgtaagaactgatctttggtcaaatgttctagctcaggacccctggaaacctgataaaggcaggatgcaaatgatgttattaggcaacatcacctctggcaaaaattaatctgattgataaatcgcatctggagaagtaatttataaatatcccataggaagtcatatatttccaattccctgaaagtggagtctgttgtaactggacataccccttgaggggaccctggaaacaatatctatggaatttcacaagaggttaattcctgtacaggcataaaacttctaaggcagaatagttctgcatccattggatgtggagtcctttttccttgcacctgagttgtgacttagaagccaaagataactcattgatggttgtgtggactgctgcaagggctcccacacgaggatgatcttaggctctctgcaggcatgctatactcccagtcccatatcctcagtgattctgatgccaagtggagcccatggtagtcatatgagtctgaaagttgagcctaagaaaatatcctctttccctcctagtgggtattgaaacaatatatgaatagattaatttagaagaactgacaccattacaaaatttagcctttctttccaaatgtatttaagtcttcttttgtaatatttgaggttttaaggctttctttttttgttttttttgagacggagtcttgctctgtcgcccaggctggagtgcagtggcgcgatctaggctcactgcaagctctgcctctggggttcacgccattcttctgcctcagcctcctgagtagctgggactacaggcgcctgccaccatgcccggctaatttttttgtattttttagtagagacagggtttcaccacgttagccaggatggtctcgacgtcctgacctcgtgatccgcccacctcggcctcccaaagtgctgcgattacaggcgtgagccgccgtgcccagccttaaggctttctttgtacaaatcttttacatttcttgttaagtgtgttctttggtatttgatgttgatgtttaaagtgtgtgtgtgtacaatatacaaatgggcatttttcttccatcatatcatccaagtgattgtttgcataagtaaaatttattaattgtactcagacaccttattgaattctcttatcatctttaagttccttcattgattttcttgagttttgcatgtatataatcataatggaaatggtgataattttatttctttattttatatctccaattctttttcttaattgctttatctagtaccttcaaatcaatgtcaaataatagtggggataatggatagcattgccttttctgattttaatcagaatgcttccagtgttcttccattaagcaagatgttggattttgggttcagatatattttttatcatgctaagaatgtaagatatccctgttttaataagaatgtttttaaaaagaatgctaatatatcaaatgcttttaaaatatctatgaggataatacgatttttctccacagatcaacaaacatggtgaattacattaacagctatcctaacatagagtcatccttgcattcctaggttaaaccctccttggtcaagatttatatttttatatttataggctattgaattctgcttgctgattcatttttattttattttaaatttttctttattttttatttttttgagatagggtctccccctgtcacccaggctggagtgcagtcatggctcactgcagccttgacttcctaggctcaggtgattttctcatctcagcctccctagtggctgggactataggtgctcgccaccaggggtagtttttttttttgttttttttgttttttttgtagagacggggtttcaccatgttgcccaggctggtctcaaactcctgggctcaaggatccacatgccttggtctcccaaagtgccggtgatattttaacctaggatttttgaattaatattcatagatgaggcagtcctacatttatatatcaagtgctatctgtgtatgggggtgtgtgtataagaactctctttctctctatggagagaggtccataacaagcataattcttaatggttttacaaatattaactcatttagactgggcatggtggctcacacctgtaatcccaccactttgggaggccaaggagggcagatcacctgaggtcaggagttcaataccaacctggccaacaaggcaaaaccccatctctactaaaaataaatacaaaaattaaccaggcgtggtagtgcacacctgtagtcccagctactcgggaggctgaggcatgagaatcgcttgaacccaggaggcagaggttgcagtgagccaagattgtgccactgcactccagcgtgggtgacagagcgagactctgtctcaattaaaaagcaaacaaaaaattaactcatttaatcctaagtttggtactattaaccaatttatagatgagaacactgaggcatggagattaaataacttgcccatatcacaactactagtaaactagagctaggatttacacccaaaagtctagtccagagtccatgctgtgctctgctgcttttaatatttctatatgtggctgggcacggtggctcacacttgtaatcccagcattttgggaggctgagacgggcagattatgaggtcaggagatcgagactatcctggctaacacggtgaaaccccgtctttaccaaaaatacaaaaaaatcagccgggcgtggtggcgggcacctgtagtcccagctacttgggaggctcagacaggagaatggcgtgaacccaggaggcggagcttgcagtgagctgagatagcaccactgcactccagcctgggtgacagagcgagactccacctcaaaaaaaaaaaaaaatttctatatgcaatttttattagcttttctttgtgtatgcatgtgtgtgtgtgtgtatggggcggggggtggtgaggatcaatgttagactcttttagttaaaaaaaagaccttttcccctctctgctctgagacagcttaaattatattgtaattatgtatttaaagagttggtacgttttctctgtgaaactatttatgtctgatgtttttatgagaggaagttcttagacaactctcctatctcttcttctttttaaattagtctgtttggccaggcatggtggctcatgcctgtaatcccagcactttgggaggccgaggtgggtggatcacttgaggtcaggagttcgagaccagcctggccaacatggtgaaaccccgtctctactaaaaatacaaaaattagccgggcacggtggcaggcacctataatctcagctacttggaaagctgaggcagaagaactgctggaaccggggaggcggaggttgcagtgagctgagatcatgccattgcactccagcccaggctgacaacagcaagactctgtctcaaaaataaagtaaataaataaataaatagattagtcttaggattcttttcagctactcttttgtttgtttttgtttaagacagggtctcactctgtcactcaggctggcgtgcagtggtgctatgttggctcactgcaacctctgcttctcaggctcaagcgatcctcccacctcagccttccaagtatctgggactataggcaaacaccactacatctgactaatttttttgtatttttggtagagatggggtttcaccgcattgcctaggctggtcttgaactcaagtgatccgcccgcctcggcctcccgaagttctgggagctaccactcccagcccctttttggctattcttattgagaaccttgaagacgacccaggaggaaattgtttttatggctaaaaaatagtagctaacatcagttcccattccctatcataaatataagatataaagcaccaaaatttacattaagtactaaactctgagactttgtgagtcctggctcactcttcaagaccccatagtactaatgtcttagagtttgcttcaaaacaaagcctattttggttttaacttaaggtttcccttctgcacaattatatatacaagtttatatgtaagctatatagctttttacagaattaaaccttgttgacttttaccaactggtagttctttctccatctgcttaatttaaactcatcccttaagagctagctcacatgtcacttctacagcctttccctgtgccaccaggcagaattaagtacttcttccttagtattctcaccatatttggcacacagtactgtctaatccatctctccctccttccttttgggacaggctttctaatacccacattcaatcacctaatcatatagatttgccatgctctgtctaaggaagtctatatatgattctatggtctattttttctaagaatgatattctgaaacagacagtcttaattatttaatttgggtgagaattctgtgagaccagtccattacaggcttctcagactgtaacaaaaatattgagagtcaaatgctctaatgtgggggatctgagtgatacctatttgagggaaacaggataccctatttgagggaatcagttgaaactcactttttcattttctcctaagactttaagaagataacagtggaaacaaatagaagatactccagtgttagaatgaataaggcctatgaggagagctttgatttcttctgaaaattctgtaaggctcacgatagcgaaagaatgcaagaaggaatggcaaggcatgattgatgggcacaaagaaattaaatactataaatcgaagtaagcctaaacagtaaaagagactcatggtgataatgaaggaatgaattgcattgcctttagtaaacctgatgactatttagaaaaagacatatattaccctcatgcagaaagtcatgatactttatgaagacccaaagaaagtacacgttactagggtttgtctatgggttaaatgtgtgaggaggaggaactatgcattatctagacagaataataatataactagctaaaacacaaatctcagaatcctaatgaaattttactcaaaaatagcacttcagggcaagacggaagatcactgttgagtgccttttgttaagtcacaaaaataggaaggaactgaattatcagaccacttcctgaggagtttgctttcctgataaggagagatcctttatccaaggcttttttttgaaaagactggttgttttgtgtggtattataactaggtatccaagcttgttcaaaaatcatatcccaatgcctgcagttatggttcaccagataatcagggttagtaagcactttaaatacagctagtatctgtttgtaggtatttatatcttgcatatgaaaaggaattattctcatcaaatatttctgtgaagtgcagtgagccggtagtattatatgtattatagtgcagtggttctcagagtgtagcccacagatccccagcaaagatgctggggtgtgatgatgtcctcaaaaccatttcacagggtctacaatgtcaaaattattttcataattatactaagatgctatttgccattttcacttgttgacatctgtactaattacatacaagcaattgtgggttcaactgctgtcaccgttacgtgaatcaaggtaatgataccaaatggttctagcagtcttcatattcttttgctaccacacatttagtttttaaaaagtcagtttcacttcatgtcattgaacaagaggtgtaaattaattttatttacttcttaactgttaaattaactattttcaactttctgtatgattaactggaaattacacatacagcaactctgtcacatactaatggttatctcaagaaagagtattagtgcaattctttgaattgcaagccaaattagctgctttattaatgaaacagtatttacaataattgacaaagtttgattattcttcttgagtacgtggtttgaaattatatgaagggaatctgttactgcaagtgaaacaaatggcgatatttgttgtcagtgagtaaatttcaagctttcaaacaaatatgagaattttggaaaacttgtatctgccctgtgagtttgacagcttcccatatggtgtgaatgccaacacccaggatttagccagaagatgtaaccatatcttgcaagggactatcagtgcctacagaaatgagatagaactgagttcactgtcaacagggtaaactggagctactacttatctttacttagcctactgacaatgagccggaatagcagtgttgaacaaccaagaaagtggactgccatctcaacaccaagatatcatacagaattctgcctcccctatcactcctcccagtctcaacatcaggggagaaagggtcaagaaagacgaaaggcagaagtgtctgacaaacagaaattacccacctaccctccaaagttttaagttccagataaaggtctagtctgccctgggaggaagtgagaagagcactggattaaaactgactgaagttttaatatgaagagaactgactcttaaatactagaatgaaatgaatttttgaaaattatagaattggtttcaagatgctgttaaggtaactgatatctaatgggaaagggaagtttgacaggctggagttaagaggcagttatagacaaaaagaaaaactgacttgtattagcatcccaacaagttaagcctcctcaataaaatggttacaacacaggtggacagttttccacaaatattggtgttctcagccttccatcccccccattcctttttttgtacaatcaatggaactgaagagggataccagcaatgagatcctggtatgagttctagcataccataatatttaagtctagaactagtccaccaatttggattagttcactcctatttgtagctctgtctgataaatgctaagtggataagaaccatatttctacatctgggaggacaccatcggagtcacagatatgaatggacaaataagcattactaatgataggagatgctgaaagtaatagtaagtatttcaaataataaagtggaggagattgctgggaacacagctcatagagcagaaattaatttgatatctcaatgcttttaactttcaccttttaatgattcaaccaaagaagaaacccaaaaggaggctcatctaacaaagaggaaaaaccagtgtattttaaatggatgctgttcaactacacaatacagaggaaggaaaatgaaggatctaaagaaagagattaagagaaaagcaagtgaaaggtaatcaaaaagtagaacctgacttggggccgaacatggagggtggacaggcatgaatgatagacagggcggaacaattcctggatgaacgagagacaataatgtagagtggctgtgacacattgcattattaatacataccgagactgaattgcgggtaatgttcatgaatctaactgcaattagtacaggtttctggattaggaaggacatgaaaaggaaagcagaaggttagaatgtacatgtcattgcctcattaaaagagaaggtttaatcttgcaatggactgaatatccatcttctgcagcactggaaaaaagcgcagcttatctatctgctttgaaaagtaggtttatagcaaaaggctcttcccttcctgcctggatagccaccactaaattgggcctctcagaactgagctcctgaaaattcatactacagaaatgtttcacttttaagtgggatttctgtttttaatttctggggaaaagatttagatagtatcccctatgatgagttttatttaatatctttactgcctgcaaaaagcccatgcttatgtttgtttttacagaagacccttcactaccttaatcaacagacctttgttaagcacttattctgtgccaggcagattaaataataaaggaagaaaaagaattattttagtgctaatttgcaaactgtgaagatatgggaggaagtactgctggacccctgaaagagtaagggcatgatgaagcctgcttctctttagagatttattgggaatctgaaatgcgtgctcattgtcacaattttattttacaactgagaggaagggtggcaaatgggcaataaataaaccttaatgcagcagttttccagttatcctgaaaactgacttcagggtaacatatatggataactccagttctcaatgaccactaatcaataaggctgaagctattgattagtggtcattgagaactggagttatatgttactggttgcaaaggaagatattaaaaagtgggcaaaccaaggaaataaattatcggttttacaaggactgtctcaaaacctaaccctaaactcaaagaaatactttttgattacagtagactcatagatggaattccatttccttaagaatcaaatgattccatttaaattcagttacaaatgattaagttctctacatcccaggggtcttggcaggaccaccaaaagtgacacgattaaaggcgggaacagacagtggaaggaagtggagaaaaaagttagaagaggattacgttttcatagaaaggacatgaaaagaaagcaaggcagattattaagacaccaacattttatctaaatacttgatttgaaaaattctgcacacttaatcacatagattctataatgtaactaaagagagccagcagattaaacatgaggaatccatagcaccttgagatttggtgacgttttacttgttttttataaaaaagattctgataataatccttgtatacaccacaaaagcacatttaaattcccaagacaactcccatttttccactattccatgtgttgcatcttaccattgatctacgaatcagtgacaacctggtctttgccttattctcagcaaattccaagctactgatatctttgagacgagccttgtatttattcatttgttccacaacaatcagttccacacaactgaaacagaaggaaagagaaaaaaactgttaagaggtgaagtaaataaagtatagcactcacagactgtttttgtggtagacagttgaaagatgaaggaaaaaattaacatcccttacttgataaactcagagacaaggtttagaatggtggttcacaactttggctgcactttagaagccatctaaagagcagttatggctgagcacagtggttcatgcctgtaatcccagcgctttgggaggccgaggcgggtggatcacctgaggtcaggagttcgagaccaacctggccaacatggtgaaaccctgtctctactaaaaatactaaatcagccaggcatggtggtgcacgcctataatctcagctacttgggaggctgaggcacgagaatcgcttaaacctgggaggtggaggttgcagtgagccaagatcatgccactgcactccagcctaggcgacaagagtaaaactccatctcaaaaaattaattaattaattaattaaaaataatacaaaataaagagcagttacaaatcccaatgcccaggctacacgctacaccaattaaatcagactctctggggatgggatccaaatattgatatattttttaaagttccttttgcagtcaagattgaggagagcaaaagaaaaccatgttagaaggaaagcagagcctcaagaaaaaagaccaaggtgaaatacaggaatactgaagtattaagaccaaaggattcagagccattaagaccacagttagactagattacaggaagatactaagtgtccataatttggtaaaatggaaatttaaaatctatttagaaactacaagcagtcctaaagaaaagccagattttaaaaataagatgctttaagacaaatgatgctcagttgaatccaggagtttgcatcctcagcataagaaaacccagcagtgtccaacaatcttcttaaaaacacctgaatttatgaacccattcactatgtttgatatctggatacagtgactacatagtcagaagtccctgaggtcttgcaaaggttatggtaactggccttacgtggtagtcttactgatgtcctgtacactttgtagtgggtcagtggtgtcagggcagcggagaatgcagggcgcaaacacaatggccaaagcattagcagacattcgattagtgtcttcctgcagagcaatcctaagaattaaaacaaaacaaaaaacaaatgagtaagggataaaaagggagcaccatagggaaataggcagaagagatgagcaaaagaagacagtatgacatgaactgcatagtactagaaggatatccattaagtttaagggtctgcagacttttcccaagttgttcctttgttcctttgtctctggaaaatgtattttcacttgttctttccttgaagcagtctaggtcagccgatagcttcccaagggaaatttgtgacctacctgctctaggccaagatcactagatgaacatgtccaaagaatgcagaatcggccaggcacggtggcccacacttgtaatccagcactttgggaggccaatgtgggcagattacttgtggtcaggagtttgagacaatcttggccaacatggcaaaaccttgtctctactaacaatacaaaaattagccagggtgtggtggcgcacacctgtaatcccagctatgtagggggctgaggcaggagaatcacttgaaccggggaggcggaggttgcagtgagctgagattgcgtcactgcactccggcctgggtgacagactgaaactgtgtctcaaaaaaaaaaaaaaaaaaaaaaaaaaaaaaaaaaaagaatgcagagtagaggctttaaccaaaaataaagatggctttcttctcaactactgctgatatttacacacaggggaagagacactactcctgacgcctctttggtcaattcctgagaatgatctgaacccctcatatgaattaggtcatttcaatagattatatatcctttctagttcagctgttagaaaacaggctaaactacacactgccaccatgaggctgaagctgttacatggttcaaacaagggcagaaaagcaactgccatgcattccagctcagctgaatatttctgctccaaggtatcctaaccacctgtttgagacactgactttataaatagaagaaaaaataaatacctgtcagtcttccaaatggagaaattccttatctatttaaaataatccaagagaaactattaaaaatcgttcccttgcttcttaaagttacctgactagatgaaagatgaggcgttccagtgtattgagatgagttcgggagagttgatcaatcacagagtatacaccacggattgtctccttcctctcctgaaggcctaaaaacagtaagagcagaaactaagactaaatatccccccttatacagtgtatcttcctcccagacactatgaagcaaagaaggctggctacagagttttaggagtagttgtacctgtagggcaggagaagagcaactcacagtaactatttaactccttttgcttgagttctatattcataaacagtctccttagtttgaacctatatcacagtaatccttaataacagcaaggggatagagatgttctagtttttcagtcattgtgtagcagattgatttaccattaaagtcaacataatttatgaatcctcagggcctaaatacctctaggaaggcctttatcaatatcctacgcacttacagcactgagaaactaaactctgaaacctgttaagcttggcataaaacagccagctttacacatagttcttgcctagatttccaatttaaatgaacataagcctaatcttaaaacttatttttaatattttaatctgttttataaccccagtctttccatttctttgtaagaagcaaccaagtgtctcactcagaaaatttttaggacactaacgttttgatgagtctctaaaaagtcaacatttgaataggtgacagtatactagccgttttgtattcactgtcaaaagcttacctttgaatctataagaattaaaccactagaggatggcttgataatctatactcaagatggcatttctttcccaactataggccttctctctaacccaggaagcctatgcttacccatagctcgaagaaattcctcatagagttcaaaggtcatgagaggattgggcaaatctcgaagccattgtttgaatacacttgcaatgacgtgtatgttatagtcatctagatttacactctcagcatctatttagagacaagagttagattaacagagccaaaacatgcaaagagattcaaataattcactttagaaactatcatcattaaaggaaggcttcatgtttcttttttttttttttttttgagatggagtttcactcttgttggccaggctggagtgcaatggtgtgatctcagctcaccacaacctctgcctcccgagttcaagtgattctcctgcctcagcctccggagtagctgggattacgggcatgcgccgccacgcttagctaattttgtatttttagtagagacggggtttctccatgttggtcaggctggtctcgaactcccaacctcaggtgatccacctgccttggcctcccaaagtggagggattacaggcgtgagccaccatgcccggccggcttcatgtttcttagtcaaactgactaacctattttccacaatgtaattccatgctttggaactgtgcttctaactgtggtgaaagaatacgtcttgtgtatttgttttccaaacctgttgtggactgaaatgtgtaaaataaaagatcatggccaggagcagcggctcatgactgtaatcccagcactttgggagactgagacaggccgattacttgaggccaggagacagaaagcagcctggccaacgtggtgagacctgtctctactaaaaatataaaaattagctgggtgtggtggcacacgcctataatcccagctacttgggaggctgaggcagaattgcttgaacccaggagacggaggttgcagtgagccaaggtcacaccattgtactacagcctgggcaacagagcaagactgtctctgaatgaatgaatgaatgaatgaatgaatgttttcgtgctgaagcactgttatactgctataaacgtctctacatgcttgctctcaatttctgtacttacctggttttggatttgtccacagaccacactttgagtaacaatggtttacatgacaaatgaaaaaacgcatacaggacactttctgaaagtaaggctaattttaagtcattcttagagataaaaggacagtgataactgagcttagaaaatgtaaaggaaacaccttcacccgtttcacttataaactccctaaggatatacagattagatgactggggaagattcaggatgattgattttcacttgtgctatttcaaggtatcagagacaaagtcagtaactgcctgtaaaccaaagtagaccaagtctcttgtagacggaacctcctgcctgagtcttaccagtcattgttattattttcatactcaattcatttctcattgatttgttcataagaaacagcactgaacacaggttcttgcccacacaaggacatgctttactctgtttagttcaaaaagatctattccttcccaacagtggtaaaatgtagaagttgagaatgaaaccagagtcagtcccctgcatgaattccagtactaaaactacagctctacaaagatacatgctcaactcactaattatcagtttgagtaactgtcatcagtgtaggcaggcaagaagatgatacacaggaaagagtaccccttggagtcagaataataaagagaaaggggaaatagattatgaattcagaagatctggggttaactccaatttggtcacttattggcgatcagtctttgggcaagatcttctgtaagcctcagttcctttttctgtaaatggggataataatatccctaattcataggattgttgtgaatattataaaaacattagtacagcaccttgcatcatcatcagcagctcattatttaatttccctataccttagtttttctctttgtcaatcagaggtatcacaatcttactaaattattacaaaaattaaatgagatctgtcccaagtgcaaattatatgctcaatatatgtctgctgagttgaccaaatgaaaccaaagactctttagaaagccaaaaaatgataacaaagcatcacagaaaagaatgcattcttctggctgctaagtaaaggattgacatgtaatgaaaactttaagagcatgaaaggaactatttaaataaaagtatttcattatgatttagagggcactatcttacctgtatctagaccctgccgaagctccttgattttattagtcgaaccagactttcgataaataccttctgtatacagtccatgcatttcaatgtagtttatgagcttttccactactaaaggaacagttcggtcttcactggtcaaacgggacagttcaaccccaaattgtcgagatgacagctctggatcatactaaatgaaagataatttttagtttccaaatgcattcaaacatcttgaaacatgtttaaccatttctttaccaggagctacttttttatttctctgaagttttatgagcatagttagaagagttgggagaaagggaattatgtttaagtaagtataaatgagatattagtttcaatccttttccaccagaatctccaaaagaaaataatggagtgaagaatgaaggcagtggcaaagggctacagcttctcctatcaaaaaattgcttcaaaagcaaaggtgggatttgggtgtggggaaaagggttggattttatatgcaaacagcttgaccacctaccagataccactagaaaatctactaatttgataagaattagagttgtcagcaagttcttaagcataagaatgctttgatgtttatataaactttacggaagtttaactgaaaaatgatttcataattaaaggcagaggtacacacagatcagcccatgactactgttacagctcttttgtatggacttgaatagcgtatctgatatcacactttatttattcatgcattcattcattcattcatttgagacagagtctcgctctgtcacccaggctggagtgcagtgatgcgatctcagctcactgcaacctccacctcccaggttcaagcgattctcgtgcctcagcctcccaagtagctgggactacaggcacatgacaccacgcccagctaatgtttgtagttttagtagagacggagtttcatcatgttggccaggctggtctcgagctcctgacctcaagtgatctgcccgccttggccttccaaagtgctgggattacaggcatgaaccactgtgtccagccaatattatactttattaacctataggttactttatatcctatgtgactgcaacataacagcttacccttaagattatttgaagtaattcactgaaaagaaaaatggcaggtattatctctgagactgaaaattgttttgcaaatctgtctttccttctcctgtaccattgtccttccctaactatatattccattttctcctttaacctgcatccaaccagttgccaagtcaatcagttcatcctctttattgtttcttttctgttctaagtgtcatcaccccagctcaaaactatatcactaaccaattagactatttcaacactttcttggcgagttttccccatattcatatgtctccttttaatatattctgtagtatatataatctgttttattatcctcaaaaacctttagcggctaattagtatatagcaaactaaagtgcaaacattcttgagtctcatactcaagaacttacttgaactgattctaatttctactttccagccttacattcatacatttgtcatttatgtgttaggtaccaaggaaacaaaatcaaggccttctgcttaagactagtagtgttaggcccggcacagtggctcacacctgtaatcccagcattttgtgaggctgaggtgggtggatcacctaaggtcaggagttcaagaccagcctggccaacatggtgaaaccccatttctactaaaaatacaaaaattagccaggcatagtggtgggcacctgtaatcccagctactcaggaggctgaggcaggagaatcacctgaacacaggaggcagaggttgcagtgagccaagatcacgccactgtactccagcttgggcaacaagggcaaaactctgtctcaaaagaaaaaaaaagaaaaagactagtagtgttagtgtgtggagataagtaaaattataaatagattaactattatggaaacacagaagagagacaactagatcaggaaagactgggctggataacaaacaactaatgatcttgaaaagacctgatgttcaaccttagtgttggaaagcaagtaatagataagtaaagaaagcaagatcttttaggcacaggaaatataaaactacaaaggtaggcagagcaaagtggctacggaaatgaagctaccagataattttaaataaaggaataatcagtttattagttttagcagtattatcagtattattttgcatcattcatgcatgtatctacatgctctgcattccagctcttaatccttagagtattaatttcatgtctattttgacatacattaaattatcttaatatcacacaacatctctgaaaagcatttccaagtctaaggcagaataggacacaatcttggaatatttagaggatgcatattaaaagttttgccttgtcactatgtgaacttggctaggttatttcacatttgcaacagaaatacctcctttctacttcagagggttgttgtagagattaagttgaacatacacagcatgacaacctggtatacgtcaaatactgaaaaaattattatagaaatagaatagaataaggcttgctgtaatgattaaattttagtcaaatgttttcctaatgctgggacacagatgtgcaaatacatattctgtttatttaaatccctatggcattagaaatgttatgacttgtggaagcaaaataacaaaatacttttaggtattaaacaaaaactttaaaaataacttgatttgaaactaagtaatctaaagcaaacatgctagaacattctatttcttgaaatgaagagacaaattaatcttactattttcaatggaaaaaaaaattctgagtatttttctaaaaatatatttttatagtttttgtttcatagttatttttcatttaaactaacttcaatgtgtattttaaataaaatctttattgagctgtgacatacacacattgcaagttacagcttaatggattttcacaaagacccagattaagaaacagaatattaccaagcagtttaaaattcccccaggtcccttccagccactatgccctttacccttcacaaataaccagtatctgtacttctgtcactaaaaattaattttacctgcttttggatattatataaatggaaaaacagagtatgtgcaccttgagttagtttaatctatttttgaactttgtttaaatgtactcttttgtctctagctttcagtcaacattatgtttgtatcgacagtttttttttttgcactttttacatttagtgaatattgataggtaaaagtatataaaggtacatggaaaaataatctaattaaactaaagagcttctacacagcaaaagaaactaccatcagagtgaacaggcaacctacagaatgagagaaaatttttgcaatctactcatctgacaaagggctaatatccagaatctacaaagaactcaaacaaatttacaaggaaaaaacaaacaaccccaccaaaaagtgggcaaaggatatgaacagacacttctcaaaagaagacatttatgcagccaacagacacatgaaaaaatgctcatcatcactggccatcagagaaatgcaaatcaaaaccacaatgagataccatctcataccagctggaatggcgatcattaaaaagtcaggaaacaacaggtgctggagaggatgtggagaaataggaacacttttacactgttggtgggactataaactggttcaaccattgtggaagacagtgtggtgattcctcaaggatctacaactagaaataccatttgacccagccataccattactgggtatatacccaaaggattatgaatcatgctgctataaagacacatgcacacatatgtttattgcggcactattcacaatagcaaagacttggaaccaacccaaatgtccatcaatgatagactggattaagaaaatgtggcacatatacagcatggaatactatgcagccataaaaaaggatgagttcatgtcctttgtagggacatggatgaagctggaaaccatcattctcagcaaactattgccaggacagaaaaccaaacaccgcatgttctcactcatagatgggaattgaacaatgagaacacttgggtctatggccatactaccctgaatgcgcccgatctcttctgatctcagaagctaagcagggtcaggcctggttagtacttggatgggagaacacttggacacaggaaggggaacatcacacactggggcctgtcgtggggtggggggaggggggagggatagcattaggagatatacctaatgtaaatgatgagttaatgggtgcagcacaccaacatggcacatgtatacatatgtaacaaacctgcacgttgtgcacatgtactctagaacttaaagtataataaaaaaaaaaaaaaggaaaattcccactagaagaaaaacatctcacagatgtagattcactactctgcattctcttctctctaaaatctagtctcctaaagtacaatttgcctgtgcagctccctgatgcttgccaacaaacttttttagtatttgtctgacataagctgctccatcttagctggaagcaaatgtctcactcatattctttgcattttaattcctgaatcaaatttctctctgtactttgccatgatttgtctactgcaaacaacatgcacacacatttatatttcagatttgcatgctattgtaacaactgtcagtatgtgattaatgaataagaaaatgttgtgatcatacatcgataaaagcctgaattttttaaaaagattacctccttgaaacataaggtatcaaacagtatgtgtacagtatattttagatctctgtgtatccaagagatatatgtaaaaacaccaaccatccatgctggtgaattttgctactcatgtttaaatttgttcatctttaattgtagcttactgcattaaggataattcctagaagatttatgagcatttaaggaagtatgaaacctcaatgcagtgttcttcaaattgtggtttacgaaattaatttagtaactcacatatagtaacggtaaaataattctatgaaaatcaattcatttttgtacatatatcaccaaacatatgaactggatcatggcataaaacatatttctactgtgatttgtggtcaaaaagtttaaaaaccactcatctgtaaaactatcaaaaaggccttaatttatttccataaggcacaaaagaccaacaggtctgttatctattactgataggtgataatttcttacctttttagagcacttggctgtggttttcagacagcacttcttatggcaagcatacttgcatactgaaaaataggtgaggaatgcaacatttttagaagtctgtacatcagtgataataacttatcaagtatactttattttagacctacgtttttttctttaaatctcagactgctgtaatatgacatacatactttgtacaatggtgtaattaaaaagaattttaacccattctattgggtataatgaagttgaaaacatgatcaaaatttctagccacagtcaatgaaaaagctttttgttctttcaaagctgctcatcctgcccctatgccatacagtaccactccccaacaaattccagcaggatacttatctttgtggtttgattcacaaattagtgttcatgttctaccacatatatgctctacaacatactaaaatctcagaaatgcctattaagaatcattcctatagataaggaaggcattactgtcaaagatccctcctgaaatgaaaactaattgggtagcacagtttaagatataagaaaggtcttatttatgatctctaaaggttcagaacagagctctgaagaaccagaacatgaagaatattgagttgtgattgggaagatgggataaagaaaatgttcagagctaaaataatttagaggagtggtgataacccagagtagctgggcagctggtgaacaggaagaggcacatttagaggaaggtattgagaacacagctggcttatgtcattttgttacactagctctggcttctgtgtaccaatacctgaatatcctttcttgagcttgtaaaatataacttgtaggcttttgaaggccaagatcaagtaagggaggccatgtcattgtactggtgaaataatcaggataacaacaaagaaagttagctaattctattaaaaaatcaaatcaggccaggcacagtggctcatgcctgtaatcctagcacactttgggaggtcgaggtgagtggatcacttgaggtcaggagttcaagaccagcctgatcaacatggtaaaaccctgtctctactaaatatacaaaaattagccaggcatggtggtgggcacctgtaatcccagctacttgggaggctgaggcaggacaagcacttaaacctggaaggcggaggctgcagtgagctgagattgtgccaatgcactccagtctgggcaacaaagttagactccatctcaccaaaaaaaaaaaaaaaaaaaaaaaaatcaaaccagcccaacatagtcataaaaaagaaaattatttaaatttttagctttaagttacagaagaaactaaacctacaagaatcatagttacactaaagggtcaaatacattacaaactacttcctattttcagactcattataattttttagactactgataataaaaccaaagcaaaactgctgttgaaccatggaataagtaaatatatagtaatagtggcaatttttctgtggcaaactgctgtcatattggttccagtcctttcctagtatttgcttcattcaattttagcccactagtaaaagcaaagcttcacagaactaataatagcaccagagcagatgtataaaataagatgagtggaggctaaaggttcactgtaagccagaaccaagttgatctacaaagaatctctactcacgttttaggatttatatatttagatatatatttatatgtaaaataatatatatattatatttatatatattttatatatttatattttctactgtaatctgctaaaaggattacagtagaaaaagtacctttttgactgtaatctaatttattcatttatccatccatccatccatccatccatctataggtttatctaaccaacaaatatttattaaaacttactatgtgccatcaccgttttaggcactgatgatataaaaaaaaaaaaaaaaaaaaaacaaataagtttcctgacctatagagcatatattttagaggtgtagactgaaaaacaagaacacaaatacttaatgtaattttgggtggtaataagttctataaagactattaagtctaagtgaaagaacagagaatttcggaggctggaggggcgggcgcagtggctcacgcctgtaatcccagcactttaggccaaggcgggaggatcatctgaggtcaggagttcaagaccagcctggccaacatggcaaaaccctgtctctactaaaaacacaaaaattagctgggcatggtggcacatgcctgtaatcccagctactcgggaggctgaggcagggagaatcacttgaacctgggaagcagaggttgcagtgagctgagatcacaccactgcactccagcctgggcgatggagcaagacaccatctcaaaaacaaaaaaaagaatagcgaatttggggacaaggtggcatttaaactgggggtagaaaagagagctctctgagaaggtgagatgtgagtgtaggcatgaagtaattgaaatattaagtcatactaaaatctgggacaagaccattttagacagagtgaattacatgtacaagactctcagtgaccaaataacatcaaaatatctggtttagagacaaagagtaggtgaagagagtatagcaagagatgaggttaaaaatttaggtagtgtaaataactcctttatgttaaaggagatataagacaactcaaggaaacagaaatgtcagtggttaaaaatattcctcaaagatctctcatacttacatttgcaaacagaggctcggtccattatccatatcaaagaagaacagtattcacagtatgtagggatgctatattgggtggctttaaagatgtgaccattgtgttcttccacctgaatgaaaaaatttagctacttatattaaagccaacacagtaaatgctgccctaacgtggtgggaaatccttcaatctcttgttaagtcttcactaggcactaattccagggggacaattaggatcttttgagaaataacataaaataaaatatatttttcctgctttccaaaagctaacaatctagataaacatgaccaaattatatgaaaaacagaaagcaatgcaacagacatataatagctgtcttacatgactctaatgttacattaaaagcagcagttctcaaagtatgttttctttttctttttttggcttttttttttttttttgagacttagtcttgctatgttgcccaggctggagtgcagtggtgctatcagctcactgcagcctccgcctcctgggttcaggcaattctcctgcttttgcctcccaaatagctgggattacaggcgcctaccactacgcctggataatttttgtatatatttttttttactagtgacagtgtttcaccatgttggccaggctggtcttgaactcctgatctcaagttatccgcctgcctcagactcccaaagtgctgggattatcagcgtgaaccactgcgcctggctaaaatatatatttttttgtaatctcaggaaacttttacagttgaaaattactgatgacctcagagagcttttgtttacatgagttatacctgttaatatttactatgctagcaattaaagctgaaaaaaatttaaagtatatattcattaatttatttaaaatgaacaataaatgtattatacatgaacataacattttaattaaaaacaactatatctttaaagcaaaaaaaaatagtggcaaaaggggtattgttttacatttttgtaaatttctttaatgtctggattaacaaaagacacctggattctcacatctactactgcactcaatctgttgcaatatgcagtttagtttgaaatatataaagaaaatctagcttaatacagatatgaaagtggaaaatgaaggaatataattttttaattaaaatttttttatttgtataaatgtatgtggtacaagtgtaattttgttacatgcataggtttcatagtggtgaagtcagggcttttagggtatcgaccactcaaataacgtgtattgtacccattaagtaatctctcatcatccatccccctcacaccccctcactcttccgagtcagtggagtaatattttaacagtcctttcagatagtaatacggcaccaaaactttacatatggtaacttaaaagttaagtaaaataccataaccaatgaacccttcctgtcctatgacagtaaaatctattgttttggacttaattaaaacttaaaactttaaccttcaaagacaccattaagaaaaaaagataaaccacagactcggagaaaacatttgcaaatcatatatctgataaatgacttctagtcattatattagaatgttatgtaattatgttagaaatgttagaacccaataataaggcaacccaactcaaaaatgggcaaaatactgaagagacagctcatcaaagaagccgttcaaatggtcaatgggcacatgaaaagatgttcaacatcattagttatcaaagaaatgcaaactaaaaccacaatgaaatactacttcatacctaccagaatggctataacaaaaaaggtaaacaatagcaaatgttggtaagaatgtggatagactagaaccctcaggtactgcaggtgggattgtaaagtggtgcagtcacttggaaaacagcatggcagtttctgaaaactggaagcatagagttgccacttgacccagaaattccactctcaggtttatacacaagataactgaaaatgtacgtccaagaaaaaacctgtacgtaactgttcatagtggcattattcatggtagccaaaaatacaaaacaactcaaatgtctgccaactgataaaaggataaataaaacgtgacatatccatgcaatggaattctatttagcattaaagaagactgaactatggataaacacaatgatatagatgaacttcaaaaacattatgctaaaaagccacatgcaaaaaccacagtgtattattctatttacatgaaatatccagaaaaggtaagactatagaaacagaaagtagagtaatagtgcctgaggctagtaaagagcagtgactgtaaactggcatgaaaaatccttttgggatttttctaaaattggattgagatgatgggaaaactatgtgaatttactgaaatcactgaattgtacacataaaaagggataaatttgtggtaagtaaatttacctccagaaagctggtttacaataccaattggtctattttgtatttggacatttaacctgtatatgattttacagtggtacatgttgatcatttggaatatactgattcactaaattaaacttccaaatgttgacacatttcattatacactagcagaaagtcatagtccttaactttataactgacctcattagaaaacttggcagatacaagttttccaaaatttgaatttttgcttgaatacacaagttttactggtaataaatattgtcagttgttttccttgaagtgacaggataactgcatatgccaaaatcttaatgaatagtttaagtaaaaataatgttctgtgaaaaaagtggctagaaacatgctgccacaaaaacttgttcatgaattttcatagcagcattattcaaacaaaaagtagaaacaactgaaatgtccttcaattaataaacagatatatgaaatgttatatatccatacaacagaatatttggctttacaaaggaatgatgtactgacacatgctacaacacgaatgaaccttgaaaacattatgctaagtgagagaaggcagacacaaaaggccatatatatgattatttaagtcaatatgaaaatttcagaataggcaaatccatacagacaaagtagactggtggttgtgaggggctcagaggaagagagaagagggattgagtgagtgctcagaaagtacagtttctttttgggataatgttctcaaattatatagtggtaatgattgcttaacatagtgaatatactaaaacccactaaattgcacactttacgtagttaaaatggctaaatagttaaattttgttatatgaattttatctcagttttaaaaaatgctagatcagcctgcaatctaattgtacaagtaatttcttgagacaaccatcatatcatggttttgcatctttcccatttcattacacagaatattaaagagatgtgaattcaagaatcaaaacttaatataattaacgtttttattatttcaccttcttcagtaaagcttctctatttttcttaaactatgagtgtgtgactgtaaaaattataatgcccattaacaaagtttgcaggcactgccttgattcacgttgatggcagttttacccatgtttgcttttgtgtcaactcaatgaaaaaggaaaatgatgttttattattacaaaaagagttgtaatatcataaaacccctaaaagtctaccagaaacccctgtagaccacactttgaaacgctggatcatatataaactagactcgagtttatacagactatgtatgtttataaatgatctagtacaaaaggatatatgttatactgttaactatagtgattatccgtgctgagataaaacactcaatagtaagtgtaacatgactgggcatggtggtgtgtgcctgtagtctgagctactagggagggtaaggtgggaggatcacttgagctcaggagtttgaggttggtctgggcaacagaccccatctcttaaataaataaatgtatgtatgtaacacgaagttttttttttttaaacctgtatatgaaacactttaaaaccctcttgaaggacacaaaaatagacttaatcagaagaaaagattcaaaataataaagatgtcagttctctctacattaatttataaatataaggtaatagaaatagaagtactaatagatcttttttctgctcaaactagacaatcaaatagttggaatggctcacgactatttagatcaactaatgaaacaagataaaaaagatcaaagcaggccaggcgcagtggctcacgcctgtaatcccagaactttgggacgccgaggcgggtggatcacaaagtcaggagtttgagatcagcctgaccaacatggtgaaaccccatctctactaaaaatacaaaaattagccaggcgtggtggcgcacacctgtggtcccagctactcaggaggctgaggcaggagaataacttgaactcgggaggtggaagctgtggtgagccgagattgcactactgcactccagccttggcaacagagtgagactctgtatcaaaaaaaacaaaaaacaaaacacacacacacacacacacacacacaaaacaagcataatgggaaatttagaatgtaaaaagggtgacatctcaaagttgatgagtaaagacggactttaaaataaatgatgttggtagccattgataagaggcaaaattagattcatatcccacactgcacaccaggacaattccataaagatcgcaatttaaatgtaaaaaatgtgaccactaaattattggaagaaaacactgagaattcctttataaccctgaagtgaggaaagtcttaactatgactcaaaattcagaagctatgaaaaaagaagattcacaagtttaatttcttaaaaatcttccacatgacaaaaaatataataagccaagtgaaaagacaactgacaaaccaggaaaacatactttcaacttatatcacagacaaagggtaatctctctaatgtacagagttgctacaaattgagaaggaaaagaccaaagccaaaagaaaaatgagtaacgaacaaaaacagactgcagttaaaaaaaaaaaaaagcaaatggtacttgagtataagaaaagatactcaatctcactgacagtatgagaaaagcaaataaaaactgtgtagagatacaaactacaaaatgagactacctttattacagagaaatgaagcaatatttatcaaaataacaaatgcattcaccctatgacccactaatttcaattctgggaatccatcacacacacacacacacacacacacacacacacacacacacacacacacacggttattcattgttcactctttgtaatagcagaagactagaagcagcctaatagtccggtaaggaatggtagccagttgtgaaatagatttctgtgtatagctactgtattagttttctattgctgctgccacaaattaccataaattcagtggcttaaaacaacacctatcatttgttatctcacagttcagtaagctagaagtctgacgcttctcagagtcagagacttttagtctcaccaggctaaaatcagatattgacaagggcgtgtgcccttctggatgctctgtggaacaatctgcttccaatctcattcaggttgttggcagaattcagttccatgtggttgttggactgaggtcctatttccttgctgactattagctggtagttgttctcagcctctagaggccggtcacattcccttgctcaacaccctcctttctccatcttcagagacatcaaaagaggattgagtccttctcatgcttgtatttctctgtcttctactacctatgtctcctgcatcatcttctacctcatctctcttactgactcttctgtcttcctcttcagcttttaagggcctatgtggttacactgggctcatctgcataatccaaaataaactgttatgttaaagtgagttgattagccatcttaattccatctgtgaagtcccttcacagcagtacccagattatgtgtgaatgaataaccaggtgacaagaaccttggagggaacatctttagaattctgcctaccatagacagagaagggtcttctgaatatattgttcaatgataaaagcaaagcacaaaagagtactagctgttattatataacatgctacattttatgtgagaaaggatagcaaataagtttatactggagaaagaaacactagaaagttataacaaaaatttaccactagaagacaaagggggttggagttagacttctcagtatatatattttaaaaaaaagtttgaatggtaaaaatatatctattagaaaaaacactgtaaaaataaattatatcagtgcaggctaaggaattcttcttttattcaatagttctactctcatttagtttgatgctctaattatcacaaatttgtccagtggcacttcctttgagctaaataaataaaaagggaatgcttgtctttagagcaaaaattcaactaataaatgtagaatgactgatggaatttttaaaaaatcactatttagcaaccatcacagcaattgattcagtcaagaatcatcaagtaataacaaaactagtaagagtttgaggaataagaggacacttatttacatggtctgaagtatatccccacaagataataattacaagggaaaatagtatctttgctgagttttttgaaacaaccttgcagatatcaaccacaataggacaaatagatatcatatatctcctgataccacacaatgaaaaatcacagcatttcttctgtgatgtttcatgccaaaaatgtgtaatctgaatctaatcatgaggaaatataagacaaactcaaatggaaaaacatgctctaaaaaaactgacctatgttcttcaacaatgccaatgtcacggaaactaagaaggctaaggaactgttcttgattaaaagagatttaaaaggcataacaattaagtgtaacaaatatcttgttaaaaaggaacaatagtgggatgaatggtggaatctaaataaatctgggttaagggatacggtttatttgtacttctcttgcaacttttctataacactgcaattatattatgtcaaacaaaaagaaggggagaggagggaatggaaggaaggcaaaaccaaaatgaaacaaaaagaactgatccaggacagtgagacaattacagctgctagaacaagttggtagagagtaatgaaaaataaggctggacagtagtgtagcagggaccatgaaagtctttcaagtcactcaacatttactcattcaattaaacatttatagatgcttactatgtgtcaggaactggcatgaacttgttgtggaaaagaatgctaactgcctactaatatccattctttgtttcttccttaaatacagatttcccaagccctatctgggcatgtgacaatctatctaaactttacttctcagcttctcttgcatctataaatggctgcataagtagctctgaataatgaaatgtgaacatatgtgatgagtgacacttccaagccatgcctaacattatgggctctcttgtccttttttctgtcctgcaagctaagatgggaatcaagaaattgagacctgaagcagtgattttgaaagtctgtattactttcatggtaaaagtggttaaaaaaaaaaaaagtggtaaaagttccaaagtatagtggaagcacaaagaaaggagtaattaaatggttccataggaaaaaaggtgtcacagagggaatgcttgagatgaatacaaagaactgagcaaagacaaaaaaaagaatgatatatttagggaatagtaattgtttctatttaagctggaaaatatgcaacaatagcctttaagactttttagagtcatgtgtatataggggtatacatgtacatatatatttgataaaataaaaagtaatttaagagatttggtactgatacaagaataaacacatcaatgaataaaaagagagactaaaaatttaaatccaaatacattaagatttgagtatactgttgtctctcagtagctgtggggaattagttccagcaaccccctgcagatacaaaaatgcagatgctgaagtcccttatataaaatggcacagtatttgcatattatttagacatatctgcatatccttccatatactttatatctagattacttacaatgcctaatacaatgcctatacatcacttcatttgtgtggattcactcaatggacagcaaattcaagtttgttttttggaactttgtggaatttctttttctaaatattttggattcatagttggttgaacccatggatgtgctgggccaactgtactataaaaatggtatttcaaaccagtgaaaaagaaatatatcattcaacagtgggcagacaactgatacactattaaagaaaaaaagcatcatcccttggtgccttggtccataactcgatcttgagactaaaataaattcaagaatgattaaatatttttgtaggaaaaaatgaaataataaacatactaggccaggtgtggtggctcatgcctgtaatcccagcactctgggaggctgaggcaggagaatcatgagcccaggagtttgagaccagactgggcaacatgctaagaccccatctctacaaaaaatgaaaaaatatttagctaggcatgataggtgtgcgtgtggtcccagccactcaggaggctaagatgagaggactgctcgagcccaagaggtcaaggccgcagtgagatgtcattacgccactgcacttcaggctgggcaacagagcgagacctagtctcaaaaaaagaaagaaagaaaatgtactggaaaaaaggtatgaatggacaggtatggtggctcacaccacccagtactttgggaggttgaggtaggtgaattgcttgagcccaggagtttgagaccagcctgggccccatggtgaaaccccatctctacaaaaaatacaaaaaagttggctaggcatggtggtgcactacttgggatgctgaggtgggagggcacttgagcctggcgaggttgtgaggctgcagtgagccgtgatcatgccactgcactccagcttaggtaacagagtgagaccctgtctcaaaaagaaaaaaaaaaaagaaagaaagaagaaagtaaaaaaaaatgataataattatgtaaataatttatctaagaaggacaaaaaactccagtagcataaagaatttaaaggaattaaaattagtagtaaataaatctactataaacaaagtaacaacataattccactcagaatatcctgaaaacagaggaggaatgtatgtgtaatacatatgtgtataaaatatatataatcatttatatataaatgattttatacggacactgtatttctggaataacaccaaaaaactggtaacagtatctctgggaagaagggctgggaaagaggtctactttataatgtatataatttcaaattatgtttatgtgactttctcaactgaaaaaacttagttcaaaatttatgatgataaaacagaactagaccaagaatgccattaatcctgattgacaccattgcctgtatcaaaccataatggcacaaaaagattggcagtcattttttttcttaagaaattaagtaaataatcaactaacttaaaaaaaatcaagggaggaaggaaaaaaaatacttcaactcatggttcatccatcctagtttcataatatggccttgctctatggtatctcaaatattcccagataataacatcttctctcacagatatccttctaattataaatcacacaaacgttattttcctctactaaactctaatattaaagttgttttcattaaaattttcattaaaaattactttattctgtaggtagaagagaggacttgctatgttcccaacacacagaaatgatactcaaggtgatacattccccaaataccctgacttgatcattacgcattttattcatgtaacgaatactcacatgtacccccaaaatatgtaaaatatatatcaatttaaaaattactttattctgaatggatataatataaacccctgatcaaaaggtacacaaagcaaaataagtctttttcctgtctctgtaccccagctgtctagttcctctttatagaaataatcactgctatcagtatactcccagatattttatatgtgtgtatatgtctgtgtgtgagtacagatattaaaatttttaaaaacatatgcaaatagtagctttctatacagtgtttatagcccttgtactttttttctttttttgcacaaatagtagctttctgtacagtgtttagcccttgtacttttttttttctttttttgagacagagtctcgctctgtcgcccaggctggagtgcagtggcgcgatctcggctcactgcaatctccacctcccaggttcaagcgattctcctgcctcagcctcccgagcagctgggattacaggcgcccatcaccacacctggctaatttttttttgtatttttagtagagatggggtttcgccatgttggccaggctggtctcgaactcccgacctcaggtgatccacacctgcctcagcctcccaaagtgctgggattacaagtgtgaaccaccgcgcctggccagcccttgtactttttacttaacaaaacatcttggtgaatgtccccttttcctttaatgttatgctacatcctattatatagatgtatctaatttatttaatcatttcccaatctatttaggttgttttcagtcttttgccattacaaactcttcttcaataaagaacctcgtgcatgtcagcatgttactgtgaaaaagtgtgattgatatgcctactaaacaaattcttaggtatgttattgctgggtcagttttttttttcctttaacgtttttaaggtttttaatacatcattgctaaagtacattctccaagaagattatgcaaattacactcctatttgtattattgaaaaatctgtcttatgtttccaaactctaggtaactaatttattttcagctttgttcaatgatggaaaaagtagaaaatcactgttacttcactttaatttgactgctaataaacatttatttgtgtatttctagacatttctatgaattgcacttattacagttcctgaattataataaaatagttgttgaataaatgtattcatatgcttgtacatttttattttgaagtgttgttctttcccttattgatatgaataactaatcttttaaggcttaaagtatataaagtgcctaaacatatctgttagtaagaggttctctgtcttccctatcctttcctttgtatacaatctcatttattttcacaaaaatctcagtggtgggtggcattattcctgctttacagatgaggacattgagactcagagcttaagttgtccagtgtttctcaatgagaaaatcctcttggaaaaccaaagcaaaccaggctaaggagttaggtatactactttcaaaattctgtacttgtgaaaaggcagaaacttcgcaataggcaaataatctataaaacagtcagatcgcacttctaacacagatagtggaaaagctgcaagtaaggatgtaaaaagatttgggaattttgtttacaagcaagaggggatgatttataatcctgaatattagtaaggtagatgataaatattctacaattagaatttgcaatttttggcagggttgaatccaggttttgtaggccctaaagtttaaagtttccagaagaaagtaaagacgataggaggaggaggggaagtgggaagtgatggcagcaaatgtagcttaaacagaaggaaccagggggagagtaggaggaaatgaagcttagagaggcagtcacgctcaagatcatgtcaagccttgtaggcatggtaagaactttgggtttcattctgacaaacactggaaatcactaaacagttctgagtagagaaaggatatgatttgatttttatgtttaaaaagtaactatggctattacatagagaactataacgggagaagagtataagaaggtagaccagtatgagactcatagttcatcggactgctgttgatagcagtggaggtgatgtgaaatggtaaggtattcaaaatattttgaaggtagagtcttgatcagactcctcccaaacgccttcatatgaacatgcaacacttaagccaatcaaagcaactggctcaacatagcagcttcttcattcacacacatttgtacatactgtttttcccaatggctagatattgactgtctaaaccactactcacttgtcaagaattagcaaaagtatttttctcttctgtaaactattccttcatttcccctttctgtatccaacagcactttgtattattcctactataatatttatcatacctgacagtaataatttgaaaactttttactgcctccacttgtagattatgcacaccttaagggcttaattcatccttgtaattgcacaaattatcataaaccacataatatatatgtgatatatattttgtatctatgtttctatctattgtattatatatatgatagatattataaatgatgttgtgtatatgatgtatatatgataacatcatatattggatatatatcatatagatgtgtctaatttatttaatcatttccctatatatttaggttgtttgcagtcttttgcttttacaaagtcctcttcaataaagaacctcatacatgtcagcatgtcagcgtgaaaaagtgtgattgtatatattgtgtgattgtatataaacatgaacaatgataaaatttgttcaaatgccttcagaaatgtcttttgaattgaaagtatttataattgtaaaatcctaaataacccctgttttctttagaagggagagaaaactcctgaagagctccttccccacccctagttctgaaaagaaataatattttttctttcatgagtaaacaatttcagttttctgccattttaggaagctatcattgataacaagtccagtcacatctaatcattctaaatttttgtaaagatataaatatgattattgcctaggtacctgataaacttatttcataaatatatccacatatatattgtatgatatacctcagacaactgatctgaaaattacttttttaatttaaaaaacagattataacttaccaaatcagtttcctttttccttcttttctttctttctgtttttggcacctgacagggggacaggagatatatggaaattgtgataacaaagactaacatactttcttacttcattgcaaatgttaagatacttgctcaacaggtaacacaatagtcatttctttattctccaagaggaactgtgcagtgctaataagcaaatgtgagaaaaaatttaaaatctgataaaacataattgccaatgacagcaacagaatggaaggatactttagagattattcttttttaaacctcagttctgcccagaagccaccgccatattaatttaaatgattgttttattttaatcattaattgatttttttttttttttgagacggagtcttgctctgtcgcccaggttggagtgcaattggtgcagtctaggctcactgcaacctctgcttcccaggttcaagtgaattctcctgcctcggcctcctgagtagctggtattataggcacacaccaccacatctggctatttttgtattttttgagaccggctggtctcaaacccctgacttcatgatccacccgcctcggcctcccaaagtgctgggattgcgggcttgagccaccacgcctggctggtattttttttttttttttttttttttttttgagacggagttttgctctgttgcccaggctggagggcagtggtgcaatcttggctcaccacaacctccacctcccaggttcaagcaattctcctgtctcagcctcccaagtagctgggactacaggcgtgtgccagcacacctggctaatttttgtatatttagtagagacggggtttcactatgttggccagtctggtctcgatctcccgaccttgtgatctgctcacctcagcctcccaaagtgctgggattacaggcatgagccactgtgccaagctgattgttttaaagattttacttcccgtattttagctgtagaaaactaccatggagctaaatataaaatatatacaaaaaggcaacatttgggacacggaaaaactcttttccatatgacatttcctgataaccatagtacagaacaatctaaacccaaccttttaaacttaaaaacaaacgtagtagaagcctactaagaatcttcttcagcataaagaccttaacctagatctagaactgaagaactgtccagaacttatttatatctgaaaacttcaaaaatgggattgaagaggttttggaaatttaaatacatataaggtagaataactaaaaataaaatggaacataatcaatacaaaatattgatggtattcttgatatgaataggtatctaattatttcatctggggtactgaaaagaaacacattgataactttgtctaagcctgatgtctcttctgtaatatggattttataaaaattatttaataaggctgaagcaagaattaaataaaatacacaacaccgagtacgattctcaggccgtaacaggcactcaaaataaaaaggttattattattatacagacttcccaaaacacgtattttcctaaaacctaattcaagaataaatataatttgtaggtttttataaagaggccactgggtaatacaatgaatcacatctttaactataatttttcaaaaggaaattcagatacttatctcttttttttttaagacggagtcgcactttgccacccagggtgaagtgcagtggcgtgaccttggctaactacaacctctgcctcctgggttcaagtgattctcctgcttcagcctcctgagtagctgaaattacaggcgcctgccatcatgcccagctaatttttgtatatttagtagagataggtttttgacatgttgaccaggctggtctcgaactcctgatttcaagttctctgccaatctaggcctcccaaagtgctgggattacaggcatgagccaccgccccaccccgatctctattaaagctaagagtataatcttgagggcagaacattatgttttaactcagtgaacaaagtattgattacagacggtttagaaaatatggtctgataaattataagacagaatgaagtttggaggatctaaagtggcgctaagttgacatgttccctgtaatgtttttctcaaaataaaatttttctcaaatttctcaaatacaagatgtcccaaacgctcttaaaaagaattcataattaaatcctttaagtaatcaaaatatatcacatttacctttgtggctgtgcaatctgaagtcttgaattcattcatatattcatctaaaaacactttaaaagtgttgacccaaactctcactggagattcacccagtgaatcacgctgctcaagcctcatcgtcttttccagaatctgttcaaatagtgcatagaggtctttataccgtatgcttttcccatcatccatctataagcaataagaaaagaaatgtatggttttataaagaaactccttaaatatagaggaaagattacacttgtaatggggtagtatttagaataaagattaggatcctgatataatttctaatgagcatgcccatgaggtcatgtggtatttgtaaactcccattctagtatgggatgaatgcagaatcaaacatgctaaattttagtaaaaaacctgacggtaataatttgaggaagtcttgagaatttctcttctaagtgtgactttttaattttatgtagctataaaggttatttgcatccctcttaattactttcctccccagaaatgaaccttgtttagatggttctactctaaaattgaaagaatgaatacttgaatcattgcctaagcatatattaagtaaccaatttatttttccaaagaagagtgacatgcccagaataacatcatattatttgcaaggaactgaaatagaatttcttttatttaaatgagatctggaatttttttttttttttttttttttttagacggagtcttgctctgtcacccaggctggagtgcagtggcatgatctcggctcactgcaacctccacctcaagctattgaatgggttcaagccattctcctgcctcagcctccccagtagctgggattacaagcatgcaccaccatacctagctaatttttgtatttttattagagacggggttttaccatattgcccaggctggtcttgaactcctgacctcatgacctacccgcctcagccacccaaagtgctgggattacaggcttgagccactgcgcccagccaagtagagtataaattaaaaagctttccagatttttctcttcacagtgaattaaagaatatattgaacaatgaaaagccaataaaatatgaattcttttacagaatatgataattcataaacactaatgcttctatagaccaaagcattaattgcacacaccaaaaataaattttctaaaacatgaccagtatcatgtgaaagtataaggtaaatctcaaagtgatataaactgatatgtagaaatcagtgtccataaactaactgccctaattccattaaaagaaaacatataatgcattcctcacaaaggaaaattagacattatagcctagcaatagagctaaaaggattatgaaaagtcacaggcaaaaacagaatcatacccaggacatctgaagtcagtatcttaaaagatgaaaaaaacagctgtaaggtgggaaaaagctactcaaggaaattcaagggagcttttaatctgaaaccattcagtttccttgtctatccctaaaacaaaaaccattcattttccttgtctatccctaaaacaaaaacaaggcactggagaaatctcttacgaaacatggcttttgtattatcttctacagcgctatcaaatttttcatatgttgaactactaaatatctcctaacatagtccaactcaccgccaatgcagatgaataaaagctgaagatattctgccgaaattccttcagggcttttttaaatacaacatccactagtgtatccttcttgctgtcttcattatctaggtcattcacctgggaaccacaaaacgagttttagtacacaatcaactaattgaaaagaagtaaatacaacagtaggcatgtattgttgcttccacaatgactgtcctcaaagtgcaagccacaggctattataggactcaggtgaaagttatgactagacagtcaaactataattactactctatgatttctaaggttccttctaacattgtatgattctatagttctgttacaagaaaactcccgtgtgcaacaagctgtaccttcccatatgaaatttgacaattttaggaaaattaaagtcactactaaagcctacaaccttaaatcctgtctacccagtctaactaatgcatatcctattattcacacctttctggtaaagaacagatcatctaaagcatggaagcatatgtaattttgatatctagagagtatatcctgatatacacaagtattccatacacagagctgctccagggcctgacgtggcaaataaagtgtacctttttcagaagaaattcatccatgctttttaaatcactgacacttgctatgatctggacagagtcattttgccaatgcatagaatccaaagccacgttgctaatcttcacacttcgcttgcgcttagcctttggagaaggttctttgttctctttgaattccttccggcaactgccgggcagttctgggctcaaaggaggtgttgggtgatatgcagctaattctacaattcaagatagaagacccaaaaggacacatttagtaaatatattgataatcttcacatccttctttttaaagttcctttaacaagtcactgaaggaaacatgcaaatatatgaatagcaaagtaacattaatgtttgaggttaggcagctaagcaataaatccagacagcacatttgtacagaaagcgtatttaaaaattaccacttttcaaagggagatgatatcatatctcccaagaagctgaagtctgatattaaaaacctggatagaaatgctttgcaggacgtcaagttagatcccaaagatctcagtcccaaagaaaagaagagaatataaaaccatactagcatattaaatgcttactgttaacaaagtcatagctttgctacatgtttgaaacaatatgtgtagctatatacaagtccaacaaaccagtggagtttgataattattattatttctttactacagtctaaagtcctgaatacttctgtgataacatttggtgattgctggcaacctgttagggagccaagtaactcaactggcttacttctgcttgggtctcttcagcatttaggattttcttaaacatcccccaaataactgtcaatttattttctctacaatttttctctacaaatgtttacaacggagaaattagattctatgtagcccattacaacttagaactagaccagatttgccaaaccctatctggagctcgatgaaaatgtttacctcctctcatttcacatgcttgtcttcccaatgtgtatgctcgttaccctctgtccaatggtatatcctgattctatccaaactaactttgataataaaggaaaaaagtagccccctacatgctaaataccacctcaggcaggaattgagagaaacccaatttcaactatgacacaagagtaaagaatataaagatacaggatacaattatattcaaacatatatcaactgattttaattctattatacagcttagatatattaagtatctattttatttagcaaagtcagtatctttcttattaataaaataaatgtttactaaagaaattatccataatcccatattagcattaaaaacaaggcctaccttaatacattttttccaaatataaataaaaagctataatcctaagttttatacatgtgtcattatgaagcaaacacacaacaaagtctgcttataatatgaattttcaattagagtttatacttctttctcaagaattagcagcaaagaatataattgtgggaaataaaaaacttagaaggatgactgtcaaccagacaagatataagaaactgataaccttagccattcaatagtagggaattcccagcttcctaaacctgtagtattcatttaacttgttattggttttattcacatccatttctcaactgatagaagcaaagccataagatacaaaaacaggggtctaactacctttccaccattctttcctctggcatagagagctcaagcccattcacccctctgggaagcttgatgatctttcctccttgtttctctattttatcctagatatgagaagatgctggtttcttactgtaactgggtctgttctatcctgccttaagctttcttccgaggacctctttctattttagtcaatgctggtatttcacccacattaccatatatccaccttggatgtatatctctgttgaagaagttggtatctttacgtagtagctaaaaactctcaggcatacctgagaaaagggcttgagaagtggtaatcttctaacattaggataacttggagagtaagtaattttcccatttagagaggtcagttttctgaacgatgaactaactgttgagtacttctcaaatgtgttatgctgcacgcccagaaagttaaaataagagctatgggactgggcatggtggctcatggctgtaatcccagcactttgggaggctgaggtgggaggataggttgagcccagaagttagaggttacagtgagctatgatcacaccactccggcctaagcaacatagtgaaaccttgtctctaaaattgaaaaataatagctattataaagtgccaggcatctgctaggtactgaaatatagcaagtacttaatatacaacacagtggttaagactatggactctggagcaggactgcctagattcaactcttagctcttccagttactatatgtgcataaataaataacttttcttttttatttatttatttgagacagggtctcactctttcccccaggctgaagtgcagtggtgtgatcacagctcactgcagcctcaacttcccagactcaagcgattctcctacctcagcctcccaagtagctgggactacaggcaaatgcctccatgcctggctaatttttatattttttgtagagatggggtttcactatgtgcccaggctggtgttgaactcctggactcatgtgatctgcccacctcagcctcccaaagcgctgggattacaggtgtgaaccatcgtgcctggcctaataaaaaaaattctctgtgcctgagttttctcatccataaattgggaataataatcatactaactctcaaaaaactgttgtgaggagcaactgacttaataaccataacatgcttaccacagtgccttgcatgtagtaagcattcaaatattagctgctattagttataaccagtaatacatatttgttaaatgaatgaataatggctacatttttttagtttagaaaattaaggctaacctatgatacacagtcatttttgaggtggttgctgcttcattgttttgtgatgcattttttggaaacttctattgtaggaaaaatgtaactttattttttagttaaggaaggatttaacaatgctggtcctatctcattagaacatccagccaacaggattgacattatgaatactacaggaatagcaaactttcagaaagagtgaacagaaattatgaacacaagttccaccctttggtcacttttaccatctggaaactgatgagctggaatcacatctgtgcctgcaaagagtggcgaaacctctgactgggtagtaggtttcactctggtagtcttcttctccccttgtttccctttggcccagaatctcatcttagctctctgaggtctgtttaaagaaataaaggtaaaaatggaaattaagagtatctcagtgataatatttgtatatatcactttaagctttacaaatcttctatgtatattagctcatttaagcttcacatttaaattaagtgtatttatctttacttttgcatttaaacttcacctgaaactgaaaggcgaaaaattatttaacttctctgggttttgttatttctatattcagatgaggaaacatcttgaatacagaaataacaaaacccagagaagttcaatattttttctaagatgaaacagccacaaagcagtggagctagaattctaactcaagttttctaactcccaaactggtttattttcattcttgtcccccatccagcttggatttagtatatacacaatttaacaacaaagaaaatactttttaaagaaatcacgaataatcctaccactctaaaaaacattagtttacctttgtttgtcatttccttccagtctttatccataagtatggcaagttttacatcactgttatcatgatgcacatagcattttaaatctttccactcaccattacataataaaagctttaatgtcactatttacattcatgagttattagtattattaacagccacttatttgaacttgtatctttctccaggcacagtgcttacaaaatttaattacaatatcaactttgcttttttcttttttcttaaagaacaggtgatagtaacaactttgcttttaacaaactactataaatatgttacaggtgaaaaactggagacttatatattaggtaactttcccaaagtttcacagtgagtgaaaaattcagaaccacatctattatattgtattgcctcttcttagtgcttgtacacgctttcatcatctacatcaaagaagtaccttgcgataacaatggcatgtagttactgaccatatattatgtattctaacctcatagttggaggtttatttgtaaattaatttatctgttcatttgtctgttcaatcattcaattaaaaaattttgagtatgtactaggtgacaggtactatgccttatatatgatattcctaatttcacaactactgtgataaacagtattatccttactttacacatgagcaaactaaggcttacaggcctgatggagatggaagttaaaatcaagtctatctggttttgaagcccatgagctctttctttcttcctttttttttttttttttaaaaaaaagcttattactaaactcatatatttatacattaaaaagagaaattgttctacaagactaattaaaaacaacagtatctctctgccatgctcaccccattttctgctccctagaggcaacacttttgaattgctttaactaattcttctgatatttagtgtgcttctgtaactatcatactcatggccacagataatgattaggcatgttccaccattccagtcctaaccataaacatgtgcccccaaaagaattatactgtaattttagttagatcaatattcagtatttacttttaatgatattcagtatttatttttattatgtaaataatattcacagttgagggatgtaattccctaaataatctactttattctagaggatttttaaaatttgctcatgaaaactgtttgatttttcatttcctcacttttctatatacaattcacctccacgtgtttccccatttctatcaactctcaatacattcaaatgtattaggtactttatcagtttcatcttgttgaaaaaaatctctcccagagccttctaacttgctccaatttggagtggtttccctcattgcctgctgtgcagttgtcatttgaaaagctactttcatcattgtaacagattccttttgtctcttttgtttcataacaacatgtcttttggtatgggtctattttcatccactatgttgggcactcagtggcgtcttcaaatctggaaaatcgtgtccttcggttctgtaaaatttggctgaattactttttcaataatttatcctccgttttctcggttctatctttccaaagttcctaccattgggtcattggatctcctgaatggagcctctaatattcccatctcttccatttcttcattttttgctcaacattctgagatatgtcctcaaatttccttttgattcttgagttgctcctttatcatatttttaatcttcaaaagctctttttattatgaatgtttctctttcatgcaccatttggtttcatgaatacaattgtatttgttatgcaaaaggcctgttgatagttacatttgtctatcttgaagtgttctattccctgtatagtttatttcttccaagttgtattttatctgttaattttggtttcttcaatataaggtatttcctcaaatatacggtgatcagtggtatgtgattattatttaaagtagggtaaaaaaaaaaaaaaaaaaaagaaagaggctgcttggaagctctagtgtgccttggtgggcctgctaaagtatggtcttccttacagggttatctggttggttgactttgcagggagagctcctgatagtaatatattcagggttttccctaagggctagacagaagtccccaaaactctttgaaccatttgcttagaaccatttgcttagagggtatgggaaatgaagaaggctggcaaatcttaacattctgtatataaacagtcattaaatccctatgttccaaatatgtgccccagccctcaattgtatctagtaaactccaggtccagagatactctgttttatactttccagataataaatttcttgttctgctataattggggaaggtcagccagctagatgtatctttctcagctttacttagctggattaggatttggctttctagtatgtattaacatatttaaaatttaaagtccatttactttttggattccacagttttattgcagttgttttcacttctaagtttttttgagggggagaaaagtccttcgtagattttgtcattttagcaattgtgggggaggacgtggaaactaaatatatataatctattatttccagatgtatgttcttctactgtgtcacatcttatttctcaatatttggtttctagtattatctgctctggatttggattaccttagattatacctctacagtcagcgaaaaagtggtctttaatatggttatgaaccagaaaaatttcaacataatcttgtaagttttctgcgaggcccaaatgcttatacaacataatgagggacaaagatatttatttgaaaaataaaaattccataagctctcttaaagagaacagaattatctcctgaaaggccttttcagttccatttctaaaatgcttacctcagaacagaatccaagtccaaagctggcacctattttcaatcttatttagtctcattctcttttacaacaaaataccataagtcatgtaacaatttggagactttccccaaatcatactgctaagtatagagggagataaagcccattatactgaagggaaccagtatgtgccaccccaaaatattcctctttgagataaatatttttaagctaaaggcaattaagaagtagatgcagaaaagctctctaccctcccctgttcgcctaaaagcaggatataaatttgaaaggtgttctttcttccctctctaccaacaaggacagaaaatcactggagacagtgtagacctttattagctagaaatgacatcagaggaatctaccaactttactccgttagtttccccataaatttaccttcccagttttgttacctttggaagcctgaaactgcttatctttgtcttgtcacttctctaaaattaattgttcattgttgaagacaatgtataagccagattcctaaaccactgttttgagttacctttcctctgcatgatgtgcatgcactgtatgcactaacttgcttatttttctcttgttaatctgtcttttgttacaggattctgtcccaactatgaacttatgagggttgagggaaatttttcttttcttctcttcaacacatatcttaactactatgtgcctataaacagtaggtacttaccatttcttgaaaaattggtaaataagtttaatttcaaaagtggcctatcaattatggtttttttaaaaaagctcagtacttaactatagtcagttatcaaataaaattatataacccctgttaactccgtgtatactttataccttatatctgaatctgaagccttctgtctcactgccaacttggtaatctctccttgagacatagtcttatgaagttttgcttgttcatcaactgacgaaaatcgctgtgatgtctgtaataattacatatgtgaaagatttaatgccaagtaaatatatgatagcactgtaatttaaattcaggttacagaattacttgagctatttaaaaacacacaaaacattgatattattcagagattcattgaaataatagagcctactgaaaactctatataaagtaatctgaaataaagatgacttggtcaatgaaaataaacaggatctaccagttcatattttctgacaatttaaaaaagaatctcaagtggaaaggcaagaaagtgaaaaccatttaaagatagagacaaaagatgcaggatctaataaatctagaacgctaagtattgtttttcaaatctccttttatttatcccaaaaggtggttattactttcatggcttaacttgctattataagttcttcatatatctaatcaataatttaaaagagatggaatatgcaatgatttttaaagagccaaaagatgacaggataaaggctcattaccattattaatggtctaaattataaacaacttataaggctatcaaactgtgacctgatttttaattggcagttcttgttccatttgtttaaaatgtgtccctctaaagacaatcctgttctgaggagagaatttcttgttatctattcaagtcatttcctaatatttcatttttctgtagttataatattctttctttagccttttggtctgcctcactatggccttattaacagaaagaggaaataccttaagttggcaaagatgaagtaatagggatctggtctacccacttacctgaaaccaacaaaaaacccagacaaaataatatgaaaccgcaatgtttaaaacaatggacagatacccctgagagatgggaaaaaagggaagtatgttctacacttgtttctaggctgtgatgcagagaggaggaacccaggtgaaacttgacagactctaagtggaacacatgaagctgaaagtccaaggtgagcacagtgactagagaccaaaagacagagtactggagaggagtgagaagcacaaagatagaactctagagatctacagaaggtccacattgaatgttcagcttgagtactaatcaacactttgtatgagaaaacaatccaagaccaagaaaaagatcacttgaaaggattaaaggtaattgagcccatcactcacaaaaggtcagtaatagtgtctatgcccaagagccagagcatataactttatgattcccagggcactgggcaaagtatagagaggatctcacctcaatagtcaagaataattagccctagactgagtactgtttgggtctaacaaacctttttttttttttttttttttttttttaagagacatggtcttgctctgttgctcaggctggagtgcagtggtacaatcacagctcactgcagccctgcactcctgggccccagttatcctcctgcctcagccttctgagtagctgggactacaggcacatggctctgtgcccagatcttactttccagacctctgtgcaaataaattgaaaagttagatgaaattgataattttataagaaaaaagggtttaccaaaattgaccctgttagataaaaggtttaaaaaagactgatttccctagaagaaaaaaagaaaaacttatccaggaactacaccacaaaaaagtaccaatcccaggtggtttcatagaaaaattctgccaaatcttcaaagaacagatagctgcaatgctataaactggtcctgactttttttagagaaataaaatacacatataaatactaagtgtatagtcaacagtgtggctgctgtcttaaggctgccaatccaaaactcttaagtaatgaactttgttcaataacaaccagttttctaccacgcaagaccaacctcaaaatcacctagcccaggtcctaaaactttatgaatatcctctcctgacttctcccttgtgagatattactaagacacagtcaaagtgggttttctcttactgtaataagctaataaacagctttgtttgatcaacaggtttttctggcagtctatggagtagacatcagagagaaagaaaattcaacacagacaaggatcagagagtatctcagagaatagcagaaataggaatataagaagtgacagcagtttggggggaataatgagaaatttagttttactatgctagaagtaatgaagattgaaattctggagagccattcagaagtcatatccatagagatgactgctttaaatctgggggatgataaaagaaaactgtacagagaaaagtataatgtttcctatactaatcctataaataaggaatagaaatgattttactaacccgcttaccattcagaagacagaaactaaaaaaaaactatcttaaaaacaactgcttagcagaaaacgccattcttcttgagtaaatgccaatgtggtgtgtataaaaatggagtgagagcagcacatagagactaaacagttattcaaacggcagcgtttgaagtaagaggttaaaaaacaccaaagtcactaaggagggaaactactacacttgtttcccctcccacagcaggtaacaactgattaataatttaaaaactcaaatctccttcaattcatttgtgaatgtctttatcccattagattgggttacttcacaattagaaaggtcatacagcaatttcttccaagatttaatgacacacttcagagtaataaaatcagtttgtccagaaaaaaaaaatccagcttttaaaactccatgtacctagaaaatcaaatacatttaaaatccagaaaatactgtgagattgtagtagattttatttagacacaatacatcttcatcttcacaatatcagataatgttagaacgtggaatattctcaagataaataaaaagagaaacacatttaaaaattgttcctacccaccccatccccaaccctggtaagtaactatccacatattctacaaagcaaagcttcttcatgcagtgtccaccagaaacaagcaccaccacctgttcctaaaatagctcgtggtgaaagagaagaaaatgagaaagctggcgacgtgactaacacactgtgcagggaagtgctctacaactactggcatgcagtgaccgtcaagcaggtgaacagaggctagaacactgaaaggagctgaatgctccaagcagaaagcccaacttcctggttcatctcagtaaaagttcccagtgtaaaagaagtctatcaccaaaaggactaagggttgttacaaaggaaactctcagaaacaaaacagcagtcataatgccaaagtttttctgcaaacaataaatctatgtatactagacaaagcaggacttttcatcaaaattagtttgttccattacataatttcgtatttaactgttaatcagataacacagtatatttccttatttataactcaaatacagggcacctccaaaatgctattattttattctacactgaagattttggctctaattatacatattatcagatacacagaatgtttccaatttctataatcctacagttcggctcaggttaatgactcatttatctaatcaggggacttgttttgcatttttctctttttgttgttgttgtttttgccttcataaaacatcacttttgtcacttaaaaactgggtctacctccaacaaaagataaaagacaacgagagtattctggacaataggagaaatttcaattaattagatctttgacaattcaaacagcttaaaacagttcaaagatagaatatttaatgagtcaaataaagaccattctaaaatttttctctgataattgacagacactaaagaatattagagagctcagttacagatatgtatggaaataaaatgttatttcactctacttcatcagtgatgttctggttcatattagacatacggtctttatcttatatatttctaggacaattccaaaataaaattctttgcattaatatacccatcaatatactataatacttgtcaaaccacatatacacctgatttgggctgagaagatgatatagttatattcttagcttaaaatggtgcagctttattcaaacacaacaccaatgttatattgtgtgattaatacaaattcacattacatatagccttctatttggctgggttggtccaggaagacactttttgctcactatatgttttaaaattcatgtttatttcttattagtggaaagtgaggtggaggaagaaagtttacaggcaaaaaatgtaaaagtgcattgtagctaaaagctactggattattttagaccaaggatcagtaaactaaaccacggatcagtaaactatggccaacaggtcaaatacaatccactgtctgtttttgcagttttattacaagacggtcatgcccatttgtttacttagtgtctatggctgctttcacactacagtgggtgagttaagtagttaagttaggtagttgcaatagagactatatgacccacaaagtctaaaatatttgttatctggccgtttacagaaaaaatgtaaggaccactgctctagaccttttaggatacaacatggaaaatttctacattagtgccaagtcaaataatcttaattttgcctaatttgtggctttttaaagtgccctttatttgagttctattaaattaaggtttagcttagttgctgtgttcactgaggtttcccatgcacaaaccattacatgggaagaagctgtgaaggttagctttagattagcaaagactatttccatcagatttgcttgctatttttcttatattgctgtaaaattaccatttcggagtcactgtgagaggcctgacccaggctgggtgcaggccctagctcacagtgagaagcttggtcaagggagagaaggggctcaataatgtcatcgtaatcatcttcctctgtatccccctccccatcggcaaaagtacctctagtcaagaaatcggagcgcgtccgcgccattcgagctttctttttatgggccggtctggcaacctgcttgaccaaatgataaaacaaataacacaacaatgtttggggtttttgttctttttgagatgatgccaatgaaagacatcagagggctcatgaatttcttgaaatatccctccacccaaccatgccctttccactagcagaagtgacagggatgaccaaaaggaatctgtatacattactctggatgaaggactagaatggaagctaaatctacactgttctacatagccaaagaagtcatctttcactgccatagtaagtcaacaaagtctcttgcacaaattgccttctttttcttagcaactgggtttttaggcaccattccctgcctggagtacaccttcataattataacaatctccgctcatggcttctttctctaaaaacacttgggagtaaatgggtagatgaggtgctctacctacaagaataataatttccaaaataatgtacatctcttttgtatagaagatagataaacaaaaactcaaaacttacctctctttggcctggcccagctaacttcacaggtttccatgctggttcatcttctttatggagttgaggatttttactgtttaaggcttctttgctgacactttaaataaaacaatgaaattacatttcagttcttagcagatatcccatggcagccaggttaaagacttccagcaaattccataaatattttcagatcttagtcaattcccaagacaattaagtcatattttttctgcttagctaattagtaataataatcctgaacctacgcataagactgaattactaaaggccttgtcctgatgatcagtgggtatattccactatgaatatgacatatgtttaagaatagtagctgcaaaataaactcaagaaataaaatagatctgatgatggggaaaggaaaataccaaacccctgaatctttagaatactagtcttacaaggggcctttccatctaatcattataaaatacctgaaaaatagccatccagggatgaggatctcattatattttatactgagatggttcttattggttagaaaactccttctgaaatctctctttgtagttttcatccactgtctttgagttttaaaacttgacgttgaggctgggtgcagtggctcatgcctgtaaacccagcagtttgggaggccgaggcaggcggatcacctgaggtcaggagtttgagaccagcgtggtcaacatggcaaaactccgtctctaccaaaaatataaaaattagctgggtgtggtggcaggtggctgtagtcccaggtacttggaaggctgaggtaggagaatcacttgaacccaggaggcagaggttgcagtgagccaagatcgtgccactgcacactctagcttgggtgacaagagtgaaactgtctcaaaaaaaccaaaaaacaaacaaacaaaaagcttgatgttgaatagcctaaaatcaacactggcagggtaagaaattgttatcaaactaaaagtatgctccagacaatacaggtgttacagtgttagcttatgaaaatttaattttgattgaaaaactgtatgatgagaatgctttatcattaaattctgggcagaaatagatgccagaatctgatgaaaaagtgtatataaccttcatggccccaattacctatattaactcagtaccatgagtctcatcaacaacatattgataatctctcctgagcagaactgtaagctccttgagaatcatatcttacttccaaggatagtgctagctaaaattagacactaacttatgatactagttggtagattaattgttcttccattcaaaatctttcatttaatttttataaaagtaagtctaggagccataagaaattatcttgccctttgcctctatgcaataagcccgaaacaaacacaaatagatgcaatctttgctagctataggcttcttagagatctccctttttgagcaatgtatgtacaatgtgtataagcctagcaatcctagcttgttctaaaggattctcttctggctatcaaaatctctcttgccacagttgagcctattggaccttcatttatcctccaaagagaaacaacaattaataggatcttgatagtacttgaccactgcaattaaccttttaactcacaacattttctttagacttcaccatgaattctttttgtcctttctcattaaacagttaaaaactactgtgtactcatcaccactacagtacaaaagggacactaacctagtattactttctaattataaaacccaatgccgatccttaatgatgaaatgcaagttctagtcccagccatttctctaaatacatgatcttgaataagtcatttcacctctatgggccccagtgaccttatctgtaacatgtgggaactggattacataattcagaagcaccagcatttatgattctacaaaatgttaatgtttctaatattacttatacaacaggatgagatttaaagtatgaattttatctgtagagtttaatataatctaatatataataattttaaagataagtagatcattaataaagcaataaaagaaatcaactcaaatacacctacaactatgtatcttggaaaaataagataaatatttcacaaggatgattaatattttttagaatccacaatttgttttttacaaaacaaattcatggatccaacagctactttataagtgtatacacctataatacatacacacacataaatgtcataattaatagacattaaagaatattaaagagctcacttacagatatgcatggaataccatgtatcactaaacttagaatgacagggaatatgtttttaacactctcttatggatgcatatgctacacagagtctttgaacttctgggaaatctgtaggttaatgggtgggaataatacttaaaactgtcattaagctcaactgcactttgtaatactatagagactcttggaaaaatatattattgatcatctcttgcccacatttacaaaggatttctctaaaatccatatgaaattttaaagggtggaacatttaaatgtttgggttatatataaaaggagagaaaaggttattttcattgttaatgtaaaatttatttttaacccaaagatacagccctcctttcatttcaatgatgacattctccataagaaccaaaagaatctaccaaatataaagataatacaagtatcttcaattttgttaaatttgtttttacgtaccacttaaaaatgcttttctcatgactacctctagtttaaaaaagtataaagaaattctacttacggctgggtgcggtggctcacacctgtaatcccagcaatttggggggcagaggcaggtggatcacctgaggtcaggagttcgagaccagcctgacaaatatggtgaaaccccatctctactaaaaatacaaaaattagccaggcatggtggcgtgcacctatagtcccagctactcgggaggctgagacaggagaactgcttgagcctaggaggcagaggttgcagttagctgagatcacaccactgcactccagcctgggtgacagagtgagactccatcttaaaaaaaaaaaaaaaatttcatttctatttatatgaagtataaaaagtaaactcttggaaacagaaagtagaatgatggttgccaggggctacaaggaaaagcagagttgttcaatgggtacagagttttattttacaagaagaaaaagttctagagatcttttgcaaaacaatgtatatacagttaacactactgtactatattatttaaaaatggttaagatgggaaattttatgttatgtgtttatcacatacaaagaagtataatgaacgtaatgatgaccataaataggccaacagctgtaacaaaacaaattaacttctttaaagcctgaaacaaacaaccttcaactactaaacttcacagctgtaaagcaaccagtattcggtgaatgcctactatgtttataggcactgtactgcccttcacaaatgcttctcacttaatggggaggaacccagtatttactctgctattcatgatcagtcaaggattcctaggatataactacatccaacttcaggtgatggtagagtcaacaattagggaatatttttacaaagagaaaatggccaagttgagcagccactttacacaaatagttggagcagaacaaggcaccttaataaaaatactccaagaagtttcccatttatacataaataaacatttcacttacaggggaatactcatattgtcctttggagtgaagaaaatgggcctagcatttccctctctggaaaggtcatcagaattgtggctgtaagactgagttggcctaaagtgttctctttttgaaatgcgattatttgagagtttacaggctacattcagctgggtgcccattctgtctgtcttggataattccttgacagtactagattggcatggacttccttttctttcaaagaacacggtgacaggtcggtcctttgggggtaagtgagcagaggaactgtctttttgggcaagagctgcatcttttaatgatagggaccccagtacattaagttctcccttatttgaggtatttaagctgaggagagaggatggcctctctactctttgctttgactgataggaagatggtgccaccaaacactctccaattcttggcttttcaattgtcttgaaggctttgcgctccttctctaaaatatctgtttgctggcgaatctgttccatcatctctttttcattctgttgctgcaactgtttttgcctttcttccttctcagtgtttagcttttctaacttcttaagcacaggattagaagactctgtattcaaagaaggaacaatctgatcttttcctgagcagtgataccttctagtttccctgttgatatccaaagtaagagcttcccccgctgtgtcttcattttccaatagtttgtttctttggatacttgtgtctagttgggaatttgttttcagtgggtcttgttgggggatataaaaaaaagtaggtagactatttgaaatgaaggagtctttcagctgtggtttacaggtaatagactcagaactgcagaccaccatttccttcatagttccatccttcaaatgctctgcactgctagtctcatttgaggcactgagggcattgtcccgtgaatcaaattttggactgctggatatcttaggtgatggaaactgcaagtctccttcatctgaaatgacagactctagtttgctcttttggctttcctcatagctcagaagttccaagcttccttgagagctctcactatcaggtgtaccccgtggagactgaaggccttcaggcaccaattctgtagaccatctgcgatcctctgaaggagaaataccaccaagagaacgaactttcagcaattctaagctaaatatagcttgctctagttctctcattctcctactttctctcttagcccggcctacttttttctgatggagatcctccaaggatctgggtctctctcttacaagcacatcttcctgcaagtccacaccactctggctttgggctctctcctgctgcttgtttggtgactccttcaagcagtccactgaactttcacggctaattcgattactctctattacagatttacattcctctatggcttttattctgttgtcaaaagaacaatcctcccatcctgaagggtctgaaccctgaatttccagagatccatatcccttaatattcaccaatccaacttctggctttgtttctcttagcctttgttcttttaaagctttaaatctatataaaaacagacaaaatgggttatagaaatatcttagttaccactgaaaataacatatttcctgagaatttaagaaaaaatgcagagttgtaaaatctttttataatacctaagttcttcttaaactaacttgaatgcacatttcataattttcctatttccatgagtcagatgatatttcattaagtgtattacttctacctaggcatttcagtcaaaatgtaaactaattcagaagtaaagctctcattttaataatgcctttattttaaagtaaacctcaaattaaagtgaaattttaagtgtgaaattaaagtgaaattttaatttaagtgtgaaattaaagtttctgaaagtaacaacagttgaatattgccaattttataagattcagcctaatgtagaagttaattcttagcagttatgatcacagaccatgtagattttcaatccaatttaattcaataaaaccttatttaacttccattatagacaatacaatgtgggttaaaatcggtatcacagtatagtggaaaagacaaattgtatacaaccaattctaatacaaattagacaagtgttaatgcagaggtataaacaaagtacttgggaagaagaaaaaaagcaattattatagtaatagagattacctttgtcttgctctgaatcctctacatgttgattgcaaaaggataatttttttcctttgttcttggtaccttttactttccctgtaggctttccatcttgcttgtatgcaaatagcagccatgtgcctgcgcctatagtaatctctccatttctgctggataacgatggctgcagcccgtaactccaagtaccgctgcctctctaagtgagcacgccaggaagcttggagaagagcagctgcactagccataacaaaagcatccttctgcacagctgcatctctgacttgcttctgatttaggtaattcctccagaatctctatggggaagacaaaataacagaaactggttgtcatatcttacactgcattttcacaggaaaaaaagagaataaatttcttatgtcataattacaggttaagtggctatgcagctaaattcttggtgattaaaaataagttttctggccaggtgcggtggctcatgcctgtaatcccagcacttttggaggctaaggcaggcagatcatgaggtcaggagatagagaccaacctggctaacatggtgaaaccccgtctctactaaaaatacaaaaaaaattagctgggcgtggtggtgggtgcctatagtcccagctactcaggaggctgaggcaggagaatggcgtgaacctgggagctggagcttgcagtgagcagaattcacgccactgcactccagcctgggtgacagagtgagactctgtctcaaaaaaataaaaataaaaaaactagttttctacaaaagcagaaagtgtacctgaaaaagataaatagaaaaaagttttctcttccagatatgtttggctaaaacagctattttaaataatataaccttgaagaagttaattacagaacctaatttaaaatttttggatgatttcatgtccttcaaattattagtaactttaacatattatattcttttgttacaattttcctaaataacactaatgggtttaaggtaatcctgacacacattccaaagatgaagatactaaagattttcttgcacaaatggaaaagatcttatggaaatgatataaatcaatgagggagttaataaaacaaataaaatgtaaaataaggtacctatcatccaaaatgagtgtctaaaaccaacggtatatatacaactctcaaacatcactccaaaaactattaaataaaaacaactatgtcaacaaatattaggtaactccttagcccctacacagatctcacaagacattataactacaaattcaatttaatttaaattcaatggaatcaatatttattaatagtctattatatgccagataatctgttgggtgttatgagcacttcaaaattgggtacgacatattctcatttctgaagttcacattattactgaaaatgttttacagtaaaaaggttctggttactaaacaaaggccaaataaactagtcaatctcatgcaaagaatcctttgcttctcacctggataataacagatgcttgtctcagatggaggaaatgctgcctacacagcaagaccctgaaccatcgctgcaacaatatgattctgcggagcacctcttggtgaagcagatcttgtaagtgctgtcgttcctgctcctttagaaagacctaccaaaaggaagaaagatgaggaatgcagcttaagaagaaatgagaaatttatttcatgaatcatcctttctgtgataagcttttagagaagaacaaacacagtggcaggcatgtaaatgaagtactgataaatattcctacagatttatccaaagtagtcattctcaaattgaaatggagatagtagaatacggaaggtgagctgggtgtggtgctacatgcctatactcctaactactgagaaggctgaaacaggaagtttgctgaagcccaggagttccagttctacggcaaaatagagagacctggtctccaaaaaaaaaaaagacaaaaaaaggaaggtaaggaagggaggaagggagggaaaaatgacaaggtgagcaagaatatcaaaattccagtgccagagattatgatacattagtccattggggaaaccactgctatgagtaaatgtattactggtaataagtcatatttttcaagcgtgttgggatggggaaaaaagttgaaaaccatagatcttgaagcttgaatcatataatgaataaaccaatgataacagtctttttgaaatccagcgtgcattaaaagcttctcactgtccaaagttattaataagtttattttatttactccttcattccactaatgtttagggtttgtgaggctgcaaaggtgaaggagacatatccctttagaaacaggaattatacctctcatttgagagcaggtagatattatatacccgaagaggaagatggtaaactaataagggccagagacaaaagatcccacctgagtaacacagagagttgaaaataataataaaggcatgcacaggagacaacgggacaattaatctccataaaaaagatattaagtaatgtgaagccacaatatgaaggttctcaaaaaagagaaagatgtttggatttaatgaggaggttatcaggaggttattatcaagcaggaggcagacataaagaactaagtatattaagataataattttaatattatgagtagaataaattaaatggaatgacaaatatactagaatcagataagtaagctgttcactgtataagcaatgtagatgagaagagataaggaataaaaataaaatggaagcagtagtaatggagaaacagaaagcgatgtaagaatctctttgtaaaaggaaaaaaaatccctaaaactttgtgaaaggattaaagtgaacggtatgccaaagacaattatggtttctagactgagaaactggaaaaagggtgacagagaaagaaagtatttgataaatttaagaacagatgaatctggatatggtcaccttgggcaagctggcttggagattacagtagagtatctatggagagatgatttttaggcagttaaaattatagtcagaactagagcactggccagagctctgtgattaatattgactacataattaaataaaaacctgggcctaaccaattgtcttctgatatctgattcactatctttttaataaacaatctcataggcaaaaattattattttttaaataaatgcactcaattttgaccagagctatacagattatatttaccatggtttttccaacttgataattatctggattaagatttattttcctgaagaaatcctgaatgttaaatttggatggaataatatttcggggaagaagtacatggaagtggctcacaaaatcctgaaaaataatttaaaaatattgtaaaatcagaaaacagtgtatgtaaacaagaccttaaactaattatcattctattaatcttttctctttcttttaaacagggtgaaaccaagacgtgcatgttaatttaagatatgataaaaggttaattcggaaaacataggaggtggagaaagatattgggttctacatatcatgacatcaaaagggaatgagagaaaaaaaaggcagaggctaattatcccttttgagaaagctttataaaagaccaaagaaaagggtatttaacaagaccctaaaatttctatcaggaaaaaaaaagcaaacgtggcaggatggggacagggtatcactgagaatgaggctttccgtcccagtaacagcaaagacttgctcagttgctgaacagcttcaatatagtttccatacccatagcagcaattgctgatacgagtagctgtgagccttgctggcagcttactatgaaagaaaatcctgctgagaaaactttagggaaaaccaaatagaatcttttcactagataattctcattgaactatttcagttactggagaggtcagtgcaaagaattgttatatcaggagtaaatttagtattagcaaacattccgagcaaatgagaatagccaagtactggattctattacaataagcttaatgagattgctgccattcaatcaaagtaaatactgtctatcccttttcaattccgtatacaaaacgtgaaatggaaaggaagaattaaggaaaataagtaagccccaaagaaataataagcaagatatgtgggaatcatttacttgatgtgtctaaatatgtaaatatcactataaaaacagaacctggaaagaatatttggagctgtatcctgattggcgaattcgaactgtttccagcatcccggtgtatcgaagctgtctaagtaccaagacatcactgaaccttaagggcagctaaagcaaatggaaaaaagattaacccagaacagtagatctccaaattaattatctgtttataagcatgactaactgttgagtatctagagattgactggaggttgtctggttaacatatacagtaactaagtatattaaggcaagctcacctctcagctggtagcttcagaaaagttctgactgcccaaccctagggaaaagagagaaaccaagcttccaggcttctctggttgtgaagagagaggaccttaaaggctcaaaaagaatgtagtcacccacagaggccacatagtccaatcactacaaaatctgtaacaagataacctacaactgggtgtagtggctcacgcctataatcctagcactttgggaggccaaggtgggctgatcacctgaggtcaggagttcaagaccagcctggccaacatggcaaatccttgtctctactaaaaatacaaaaattagccgggcgtggtggtgcacacctgtagtcccagctactcaggaggctgaggcaggagaactgcttgaaaccaggaggcggagattacagtgagctgagatcatgccactgcactccagcctaggtgacacagtgagactctgcctcaaaacaaaaacaaaaacaaaaaagaaaattcttttctgacaggacttcaagaggtatttgcttctcaaattctgggtgatgctaaatcaaatccaaataaacaccttacaggcagggaagtgtggaaaaatccatttaaagtgtttataacatactattttccttataaatattatagttagtgcttcccctccacttattctgcttaaaagtatttaaagctcagtttgaagtaagctgagatatgtgctctcatttataggacatttttaccttttcagcattagagcgaatgcattttacaaaatatggttctgcttgaccaagtgtttccattagcttgcttaatgatgcctgcaacagaaagcaatataattatcatactcttccattccaaactattaacaaataatttataactataatcaacatgctggcaaaacattcaaaaagtagaggtacacatagaaagaggtttttgaaaagcacattgtgtatattctcatactggttaaattatggataattaaggataaagatggtagtttaatattaaagcagatagcctggaaatagtaaatattgcagatgttttcagaacaatcaaatatagaatttttttcacttttcttcacatttcatcaaacaattttattcaaactcatgtatcctacaacttttaaaatgattcaggagggtatccagtaaggtagtaagcccttgctttactttaaatgtctacaaagtatgtaatgatatccctttttttattcctgataatggtaatttgcacattctctctttcttcctgattagtggctagaaatttatcaactttttgatttgctcagcccaggcatggtggctcacgcctataatcccagcattttggagggccaaggagggcaggatcacctgaggtcagaagtttgagaccagcctggccaacatggtgaaaccccatctctactaaaaaatacaaaaattagccaggcgtggtggtgcccggctgaggcatgagaattacttaaacctgggaggtggaggttgcagtaagccaagatggtgccactgcactccagcctgcgcaacaaagtgagactctgtctcaaaaaaaaaaaaaaaaaaaaaaaaaatttggatctgcttaaagaaccagcttttggtgtcagtgttttgtctatttttctgtttttcatttcattgaattctgctgttatctttattatttacttttctctgcttgtattgggtttcatatattctttttatagtttatcgaggtagaaatttagattattgaattgagacatatctccttttctaataaaagcatttagtgctataaattaaccttggagcactgctttagctgcattgcacaaattttgatatttcattctatttaaaatattataaaattttccttcctctaaaatatgtattatttagaagtcgcttttacatattctaaatatttggggattgatgtctttctttgatttctggtttaattctattataaatacaacattttgtatgattttaactcaaaattgttaaggttttatggcctagtttacgatctaccttggcaagtatttcatgggcacttaaaataaatgcatattctgcaattgttggctagggtgttctacaaatttcagttaggtcaagtaggttaattgttctatttaagtcttccatatccttcctaattgcctacttaccctgtcaattaccaagaggtatgctgaagtttccaagcataactgcagatttgtccatttttcttttaattctatcagtttttggttcagatatttgggagttctgttattagatgaatatacatgtaagacttggtaaattgcaccttttatcactatgaaattatctccctttatccttggtaattttctctgttctgaagtctactttgtctgactctactatagtcactatagctttcttttggtttttgttcgcatggtttattttttttcattttttaaccctttagtatcattgtatttaaagaggtttcttgtagataacatacagttaggtcttattttatccaatcagataatatccatttctttcttttttttttttttttttttcctgagacagtgtctcgctctgtcacccaggctggaatgcagtggcacgatctcggcctactgcaagctctgcctcccgggttcacgccattctcctgcctcagcctcccgattagctgggactacaggccccaccaccacacccggctaattttttttttcttttttttttttattattatactttaagtgttagggtacatgtgcacaatgtgcaggttagttacatatgtatacatgtgacatgctggtgcgctgcccccactaactcgtcatctagcattaggtatatctcccaatgctatccctcccccctccccctaccccacaacagtccccagactgtgatgttcccattcctgtgtccatgtgatctcattgttcaattcccacctatgagggagaatatgcggtgtttggttttttgtttttgcgatagtttactgagaatgatgatttccaatttcatccatgtccctacaaaggacatgaactcatcattttttatggctgcgtagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatgatatctcattgtggttttgatttgcatttctctgatggccagtgatggtgagcattttttcatgtgttttttggctgcataaatgtcttcttttgagaagtgtctgttcatgtccttcacccgctttttgatggggttgtttgtttttttcttgtaaatgtgtttgagttcattgtagattctggatattagccctttgtcagatgagtagattgcaaaaattttctcccattttgtgggttgcctgttcactctgatggtagtttcttctgttgtgcagaagctctttagtttaattagatcccatttgtcaattttggcttttgttgccattgcttttggtgttttagacatgaagtacttgcccatgcctatgtcctgaatggtaatgcctaggttttcttctagggtttttatggttttaggtctaacgtttaagtctttaatccatcttgaaatgatttttgtataaggtgtaaggaggggatccagtttcagctttctacatatggctagacagttttcccagcaccatttattaaatagggaatcctttccccattgcttatttttctcaggtttgtcaaagatcagatagttgtagatatacagcgttatttctgagggctctgttctgttccattgatctatatctctgttttggtacccggctaatttttttttgtatttttagtagagacgaggtttcaccgtgttagccaggatggtctcaatctcctgacctcgtgatctgcctgcctcggcctcccaaagtgctgggattacaggcgtgagcctgtgcccggccgataatatccatttcttaattggactgtttagagcatttacattgttaataattagtatgattggatttagggctaccaattttattactggccttctgtttgtcctctctcatttgttcctcccttcctcctcttactccctgtctgtttaaaatagacttttggagcagttttaggttcacagcaaaaatgagcagaacatagaattcccatatgcccctttaccctcacatgcacaatttcccctataattaacatcttgcattagtgtgttatatgtgatgaaccaatactgacatgattattaactacagtccataatatgcattagggttcactctttatgttgcacattctctgggtttaaacaaatatatagacatttattcaccattgcagtatcatacagattaatttgactaacctaaagtcctctatgctctgcctactcatcctcccccaactagatcctggcgactactgatcttttttactgtctccatagttttgttttttccagaatgtcatatatttggaatcttatggtatgtagccttttcatattggcttctttcactcagtaatatgtatttaaggttcctgcaagccttttcatggcttgaaagctcatttctttttagtgttgaataatattccattgtctgaatgtaccatagtttatccattcacctactgaaggacatcttgactgtttccaagttttagcaattatgaataaagctgctataaatatctgtgtacaggttattgtgtggacataagttttcaactaatttaggtaaataccaagaagttgttactgctggatcatatggtaaaaatatagtttataagaaactgtcaaactgttttccaaagtggctgtaccattttgcattcccaccaccaatgaatgagtgttcctgttgctccacattctcaccagcatttggtgttgtcattgttttggacttctgccattccaatagctgtgctgtggtatctcatttttgttttaatttgcaattccctaataacatataatgtggaacatcttttcatatgcttatttgacatctgtgtactttctttggtgaggtgcccctcccctctgttcaatatactttagtattccatattaatttatctacttttcaactatctttgtactgcattttagtagctgctctagggattacaatatacaaacctaacttgtcacagtctacttacttaagagtcgatatttcacaagttcaagtaaaacaaagaagtcttacaactatatatagacccctgttactgttgtgaaattacatcaacatacaaatttttaaacttttaactgttcgtttttcttgcaaatgctattgtagtataatatacatagggcttggcacagtgtcacatgcctgtagccacagctacttgggaggctgaggagggaggatagcttaagcccagaagctggagtccagccagggcaacattttatttatgagactccgtctcaaaataatgataataataatacacataaaatattaaaataataagtgtaaattatgactttttacaaaaggaagacattgttgtaactaaagccccaattttatatatatacacgtatatatatatacgtatatatatacgtgtatatatacacgtgtatatatatatacgtgtgtgtgtatatatatatacgtgtatatatatatataaaatcagaaactcagaagcccctttgtgccccatcccattgactttagcaagctcactgtacataagctatgtactcttatttccacaccccaaccaagggtaattattattcttacttttaagatgataagttaattttacctactattaaagttcatatgaatggaaaaatacaccatgtactattttgtatttgttgcatacaattatattttgtaaatttccagtgctgtatattagtgatccattatttggctatactggctatactaccattaaactatccattaagagatgagtatttcgttgtttccagtttattatgaaaaattttgctatgaacatacttatacttgcctcttttaactgttttccaatatgcttgtatcaatttacatttcaacagtaccatataaggttctgaatgctccccaatcttgccaacatgttgtataatcagtttatttcagccatgttggcaagtatgtaacagtattgctttgtggtattaattggcatttccctcatgaataataatgttgaacaggttttacataggtgtgttggccttctggatatcatcttttataaactgcctatttgagacttttgtccatttgtctattaggttttcttccttttaaaacactgatttttagttcttcatattatacaagtccttttttagtcttgctctttttcttcttttaatggtgacttttttggtttaaagttttattggaataaaatctacatactattaaaatatacacattgtagttcacaaatcaatgagttttagtaaatttacacagttatgccactatcactacagtccagttttagaactcctctatcacccccaaaaaactccctcctgcccatctgcagtcaataaccacttgagaagcagccccaggcaactaccaatctgcttcctgctgctataaactatcttttaaaaaaatacattcttttttagatggcttttcctgtgattataaaagtaatatgtagctattctagaacacttaatacatacatatatgttcagagaatatcagcttgggtttaatttgactaatgactaaattcttagagctataattaaaaccaggttaatttcttcaaaccaatcagccttttcaaagggaattcatacttctacaagtatgaattcaattcaaatatgaaaacaagcttaatgtatcctacatcttccttatacccacagttagaagactcctagggaagagaaaaatttaggtttcaccgcttgaagaaagagtatgttgactgttcacataacagcggatatttttcctagcaacctgtggatccctaggcagctgagtatggagaggagtagcagctttaccagtaagttttagtagctacaacaagcaacagcatgtgtatgactgattatattaggagaaagccacaaaacttcttttaaaaaactactaagtagagacatagtgctatgaagtgaccagactttgacatacaggtccatgcataaacattgcacagttctttatgatcaagttgtatcatcccagtcataacttaaggctttacctgctttgaaagtttggtggtcaaagggattgactcattaaaatctaacattagcctgcagaagacaaactctcaagagggaatgttttagagtatagtgaaggtggtaatttaccacaaaaggctgaaataatacagaaaatatacattatagtctaccatgttgttacttgtttctatttatcagtctgaattttctttttccttttttttattgagtatattttatggttccattttagttcagctattaccttactaactgttaactcttttttaaaggattattctaggatttgcaccttttatcacagtctaccttcaaataatactataccatgttctgtatagtgtaaaagcttaacaacactatatttccacttagccccactttaggtgttttgtgatacttttattatatattttatttctacctcacaatatactattatttttgttttctatagccaattattttaaaaagagaaaagttttttttttttttcttgagacagtctcgctcttttgtccaggctggagtgcagtggtgcaatctcagctcactgcaacctccacctcctgggttcaagcgattctcctgcctcagcctcccaagtagctgggattacaggcgcccatcgccatgcctggctaatttttgtattttcagtagagatggggattcaccatgttggccaggctggtctcgaactcctgaccttgggtgatctgcctgcctcggcctcccaaagtgctgggattgcaggtgtgagccaccaagcctgtccaagaaaacatatttttaaaatattagcctacatttctatcaatctgccactattcatgttttgtgtaaattcaaacttccatgtggttttcccatcatttttcttccatgtttaaaatttctgatattatagatctgctggtaataaattctctcagcttttttggtctgaaaatgtctctacttaaccttagtttttaaaagatacattcaccacacatagaattctagggtgactttttttctctttttggtcttttgaagctatcactcttgtcttatggctttgatagtttctgatcatcttcacttagttacacaaaatgtctcttttctccctctggctaagtttaagatgctctctttttaactggttttagcaatttgatataatgtgtcttggtgtgtttttgtttgctctgattgaggtttactgagattctttgatctccgtagttttttttttttccatcaaatcagaaaatattttgctcattatttcttcaaatatatttttctgtgccctcctccctttcatctcctgagattccaattacatctatgttagactgcatcatattgctccataagttattgctattttcgtttttttacatctttgttgctttctctgggctttaataaactatgacttcaaatgtactacttctgaactgtctaaccgatgttaatccaatttagcttgttttttattgtcaaatattacatatttaatctctaaaagttccatttgagtctttttcatatcttcagttttttcattttcataatacaaatggcccttattggttgcaacaggcagtgaaagacaggacagaacaactccatctcctgagaaagcgtccagagactctgtcatcaccttccaaaataaaaaatctattttgttcttatcatattcatgttttttgttatgtctttgggcatatttaaaagatacattatagctaatttgacattcttactatttacatcatctccatcattttaaagtctgtctctgattattgatttttttttcccccttgttatgggttatttttttcctgactctttgcctgccttgtaatttctcatcggatgttagacactgtgttttacattgttggattttgttgtattcctttaaagagtgacaaacatttttcttaacatgctgttaagttacttaggatcagtctgattcttttaagacttaatttttagttttgtgagagcagggccagagcagcctttacattaggactattttggtcccattgctaaaacattgtctttctgaggattctacctaatgcctcatgtaataaaaggtcgtttcactctggctgatgagaacagaactactcctctaatcctgtataagtaccagaaattgttaggtctacaggatttaggtgattagaataatcattctttccccaatctcatggaattttaactcacatatgcacagatcagtagtcagccacagagactcaaggagacccctcagcagatctctagctctttctcttcatacaatttccttctcctctttactctgcctcacaaattctagttgcctctacctttctatctccatctcttcaattagcaagaccactggcatttgtttgggtttcctcttcctgagccgtagcaaatcatctttaggtgttaatctggggctttcctcatttatttcccctattctcagagattggagtcccgtaatgcttactaatatctgaaaatatttgactcatatcttttgtccagtttctggttgtttatagcagaagggcaattcctataccaattaatcctttgtgagttctatggtatcattttcatgaaaataagcattcaaggaagggcacaaagacggctgggtgccatccattttgactacctgcaatttggtcatctgttacttggtttcctcacctttataataagtataatagtaattatcctagaataattggagaagaacttagacaacacctattagacaatgcatacgtgtaaatttttggcaaagggcctggaaaacataccatacattggtcattatctatggatggcagatgactttcacttgttcttactcatgtatattttctaaataatcaaaaattaactcattacttttgtaataacttaatggccgattagaaatatgaaagaggactctttttctaaaaattaaatataattcatgaatataaattgagaatatgtaaatttggaaggattttaaaagacacaataggattgtgattataactaagtttttattgtactagctatatggtattcttcagattaaagaatgattttggtatacatggcacctgtaaaagatccaaggtaacaaaacacttaacagcttaataattctacctttcataatcacgagattaatgttcccttttcagacactgagctcaccaaagtactttttgaccagaatttggcttcccatgtggatttgctaatcaggaaaaaaatatgctaataaactaaaaaattgtattaagtctgcttatgactcatatttatgttgtatattaataaacttatattactcaacatgatttttttttctataacccattaatctttgcatttctaatctacaaagtgaacatccagactctggattgtgaggacagaagcaaggtaaagacagacttccccaagcactatcttctcattcttcccaaccaaatgccattaacccatatgattattaggaaggatttttaaaattcatggcagtgatttcattatactcaattccctttcctttaagcttatttgcacataatgagttatttggctccttggtcttgctttttcatttctttttttttttttttaaagagaaaggatgtgaccaaatagcctgcacagattcaaatttttctttaggcccatggtgagaattacctaaaataaaatgacatttctagcccacaatttgaagaactgtgcttataaatcaaacaagatcatatacaatgatacattagtagatagcttatgttcaaacatcctagctgcaaaagaagcattttaaaaagtgttaacatatacagatacacctatcatgaataaggaaatttttatacaacagtgaacactgcttctgtgatataaacatgaaatagggtaaaattatgcaaagcatttgttacctaccagatattttgcttactttcataaatatctaccaaatgaaaagatcttaggagatagatgatttgagaagaatggaagaggcaatttaaaaaggaatttgaaaaaattattctggaagaaatttggttaactattatcatatttattcctaaaagccccaaaaaagaactggatttctatttatacaaaggtaaaataaatacacaggaaaaaaaccttcagcctcatttagttaactattgatggtagcagcatgaggtttaagcagggaaaaaaacatatatcattatgctaacagtgacattatctaagcagcagggtttaaaggcagatttgtttataacatcaattttctgctttctcctcacactgaaaataacaaatattgagatatccattatccagacatatgtggatgaaaaacaaaggcatctgactttttttttttcatctttggttcttttttccaaaatgatcagtaatatatggctttttagtcacataaattaaaatcccattcaagtaccctgcagatcactttaacctttcaatgacaatctgaaagatacagattcttatttgttttaagcgaaacaagaaataacctgaaactgggcactgatgctgggaggttttttcttcttgtgtaaatgaagaagagacttggtaatgcgatcttgtagtgtcagtcttgtcaggtgctttaaagaatttacttctagcaagtgctgaaagaagagaaaaaataaattgctcacataaattaatctaacaataagccaaaattctcagccagttttcatcatttcctatctatatgaccatttcccatcttaaatgactgtagtgaatatgaaagactgatatccaacattcattctattctcctgtcttcctctagaagctagaaagctaaaaagaaaagtacacttcacaaactctcttgcatctagagttctggatatggtttaagtttactaataaaaggcccacatgtgaaactgggaaggtataactgaggcagaggctctggctactagttctgcttctgctagcaaaaatgcatatactttatgtaccttttttctgtggttccagcatccaggcactagttttgtaaatgctcagaggcagagtgcagaacatttgtgttgtcatcacaactatactaaatgcagcttagccctggagcaaatagttgtagcagtttcttccagatggctagattacaccacaggcagtatgtaccgcaagtagcagctgcactgacagcttcctgatttcctagctttctaattacatttagggacatttctgcaaatgttattttaacatgtgacttctaatgattttataagtgcctgcttaattccctttctacttaaaaatatctactgtaattactgttatctcaatcctgactcacagagacaacaattaaataccagggcgacagtcggtgtgccagggacatacacaaaaaccaagtaggctgggcacagtggcacacgcctgtaatcccagcactttgggagactgaggtgggcgggtcacgaggtcaggagtttgacatcagcctggctaacacagtgaaaccccgtctccactaaaaatacaaaaattaggcaggcatggtggcacgtgcctgtagtcccagctactcgggaggctgaggcaggagaactgcttgaacccgggaggcagaggctgcagcgagccaagattgagccactgcacaccagcccgggcaacagtgagagactctgtcaaaaacaaaaaacaaaaaaaccaaagcatagtccctattaaccctcatcatgatgtactacactaaaaattaggaaaatgggagttagacatgaagcaactaaagtatacaaagtaaagacagtacaagtatttgggagctttttgagccaatcataattttttaaaccacacaatatttatggtagtgagtttgtaaatgaaaagaatatatctatacagatgtaaactatatgttatttaaaaagtaatcaaaaatcttaatgtatgagaaacaaaagattgtgttaaaaacatgacaaattttcaagtctaaaggtatctattttgacaatataaacattaataaaaccatgcaaattgaaagaagtacaacacacatgtaaacaatctgaattaaggaaatgttatttcctacaaatgaaaaggcttatcatctgtatgtaaaaaaaaaacttttaaaaattcttaaaaagacagatatcacaataaaagaaagggcaaagattatctgacaaggcaattctcaaagtaaaaatggcaagtaacaaaaccacaatccattcaatctcacttgtattgaaggaaaatgccatttcttttaaaagaggttttctgcatcagattggccaatacaataaagactgacaagagccagtattcatgaggtggtggggaaacagacatatactatatactcactgttcttaggaatgtaaattattataactttcctgacaagaaatttcacatctagatatttattctaaggagttatcaaacaaatctatgttgtttataacaatatacttcaaaaaataatgaaaaattatagatatgcaattatatagaattatttatataaagtatgcttcatttacacaactgagtactccacagctcataaagttactgtaaatctgtatttcctgacatgggaaaatatttgtaagcactattgatcaaaaaaaaagccatgtaaaacaacacacatgtaaaaagggcatttgtgctaattagaaagtttttgttttacttttattggcacttttgaattatcacagcttcacggtatgtatattcatgaaaagtaatttttcatactggtcaagaatcaattagaataatttataggttacccttatgtgaaaacaaattagcattgaagcctaaaataattcccccacttccacttttaagatactatggagaaaaagaccttggaaataaagtttgagtttaaattgtttttcactatgaaaaaaacaccagagggactatgcaaaataaaataactattagaaaatctttgctgtcatgtatattgcaaaagtttgaaaaaccaaacatgacattcatttctgcctcagagtcattccaatttttttcatttgcttggaatactctatagccgggccctcacaagacttggttttacttggcactgaatttgtagtttaaatgtaactttctcagaaaactcttgcttaaatactgaaaaaatagcccacttctatgtcaattacatgtcacttaattttcaacactgcacataatatcatctaaattattttttcatttatttgttaatttgtatattgtcttctttttctctaaaaaataacctcctgcagtgccacgcactgtggctcagggctataatccgagaacggctgaggcaggcagatcacctgagctcaggagttggagaccagcctgggcaacatggcaaggcttcatgcctactaaaagtacaaaaattagccaggcgtggtggcgagtgcctgcggtcctagctattcgggaggtggagataagggaggattgcttgagctcagggggcagaggctgcagtgaaccaggatcgcaccactgcactccagcctgggtgacagagcgagacactgactcaaaaaacaaaaaataaataagagataacctcccaaaggattctaactgtactgtgcatccctgtaccctcaatttctaaaatactgtctggtttagagtaggattcaataaatattagtttgaatgaattaaatacctagcaactggccaggcgtgaggaggccgaggagagtggatcaccagaggtcaggagttcgagaccagcctggccaacatggcgaaaccccatctctactaaaaatacaaaaaattagcaaggcatggtgacaggcgcctataatcccagctactcgggaggctgaggcagaagaatcgcttgaacccaggaggcagaggttgaagggagctgagatcgcaccactgcactccagccagggcgacagaataagactccatctcaaaaaaaaaaaaaaaaaaaaagctagcaactaatgaactttgagcaatgctttccctagcaagtggagaccagacttcttcccatatacctaacaataacctggtcaatcaacaaatgttcagagtcattactaaaggtcagactctgttgtaagtgctaaggatacattgcattcaagtccaggctattaggacattaaaaaataattcaatcatgcataaggtttatgaaaaaaagataaaataggaccgtaaatctagaggtaaagggatacagaattatttcctttcttagggcttcagttccttgtctacttcattcctttcttaattccatcattatggttgagtttattaagcttaattaaccagtttattatttttttcaacaattatctaccacttgctgtgcaaggtgctgtaggcaaaaagattaatgagatattgcttgaatatagtctaactgttttgagtctcccaaaattcatatattgaaacctaatcctggtgtgatagtattaagaggcgaaggggaggggcccttgggaagtagctgggtagtggtattagtaccttgataaaagaggcccaaaagagctgccatgttaaaacacatagaaggtatcattccatgaggaatgaaccatcactagacatcaactctgaaaacttgattttgaaattccctgcctcttacactgtaatatatttcttttgtttataaattacccaatctaaaacattttatcatagcagcccaaacaaactaaggcatttctcatgttattaaaaaggactaaaatggctaataaaattaacttcaaggttgggcacagtggctcacacctgtaatcccagcacttcggaaggctgaggtgagcagatcacttgaggccaggagttggaaaccagtgaggtcaatatggcaaaaccctgtctctagtggaaaaaaaaaaatagccgggcatggtgacgcatgcccgtcatctcagctacttgggtggctggggcacaagaactgcttgaacccaagaggcaagcggtcagcaaaaatcgtgccactgcactccagcctaggtgacagagtgagactttgtctcaaaaaaataataacttcaagatttgagcccaagtgactataaaaacgtactaggggagcaacacagtaaaattagtttgagcatgaattttgagacaaggaagatatcaaagtacaaatatataactggacaatgaagctgtcactaaaacaatgtaactaaaaaaaataggtcatgttagaaaagtagatctaatacaggtgacagtttcaagttaggagggaataaattctaacaagaaaaatgggaaagtattaccaaaacagagctatcatcttgtggaaggacgaacttgagttcatgaaagctgcctctgcatttcaagtggatgcttgtctgaagcaaactaggctaacttgttatccaaaagggaagagctgtgtgtcatctcagagtcatagttgtacaaactaagtgctgactgtggctcctgtcaagaggtttgatggaaaggctccctgtaataacaaggatctcagatcattttgacttatcctgcaaaacccaacctagatgtcatcccttccacccactccttctcccgcactccatccctacctaactcatccctacttcttaaatagagaacttagtctgagacgaaattagtgagttgaggatatttggcctcctactatatactcaaaaaattcctcaggatagggatatatcttatctagcatagcctgtgtaaacaggagatatttttaataaaaagttgaaatgaattaaaagtagtaagaagtttaaaagatatatattcaataagtaaaaaggtcaaaaagttagtatgagtctaaattcctttccctcaatgatcttttttccaatagctttactgaaacaaaataagctgcacgtatttaatgtatacactataagttatgacatatttacatagctatgaagccatcaccacaatcatgataatgaacatatccatagcccctaatgctttctttgttccttctctcactttgcaagtcctctcttttccctaaacactgcatgctgcttcctggcaatctttttctacttttttttttattttttgagcatggagtctcactctgtcgtccaagctggagtgcagtggcgcgatcctggctcaccgcaacctccgcctcccaggttcaagcaattctcctgcctcagcctcctgagtagttgagactacaggcacgtgccaccacgcccagctaattttttgtatttttagtagacacagggtttcaccatgttgcccaggctggtctcgaactcctgagctcaggcaatctgcccaccttggcctcccacagtgctgggattacaggcgtgagccaccgcacccagcctctggcaatctttaatctactttaggtcactgtatatttttggtttttcatcttttttaaaatgatgaataataattgtatatatttatggggcacaatgtgatattatgacacatgtatacattgagtagtgattaaatcaggctaaataaaatatctcacatacttatttctttgcggtgagatcacttgaaatttacttgtacagcaactttgaaatatataatacattattatgaaccatattcaacttgctacacaaaagatcactagaacctgtctaactgaaacattatcctttgaccagtgttgtccctttccctttcccacccttataccccaaacctttgggaatcaaaactctattatatactgctatgagtttggctttttgttgttgttatggttaaaagaaaccttttatttaaaaacaatatgacattttaattttaattagcattcattaagtagccagtttttaattcctggggagcaaatatgtacaaatatcaagcactaaataattgataattactaatgtacttaacattaggtaatttagtgtcttcctcctttccaatttctatgccttttttttctttctcttgcttacttgctctggctaggacttccagtactatgttgaatagagaaagtggtgaaagcgggcatccttgtcttattctagatcacagaagaaaagctttccatttttccttgtttagtatgctgtctgtgagtctgtcatgtggtctttattatgttgaggtacatctgttctgtctatatcatgagagtttttatcatgaatgagtgttgaattttgtcagatgctttatctgtgtctattgaaataactgtataattttttcccttaattctgttaatgtatcacatttaccgatttgcatatgttaaaccattcttgcatccctgggatgaatcccacttagtcatgatgttatctttttaatgtgctattgaatttagtttcctagtagtttgttgaggatttatgcatccatgttcaatcagagacactgtcctacaattttcttttttgttgtgttcttgtctggttttcttatcaaggccttgaaaataaatttggaagaattctctcctctccatttttctgaaatagttttaaaaggactgagactcattcttcttcaaatgtttggtagaattgagcagtgaagctgtcatgtaatggacttttcttcaatgggagactttttattactgatttgaactcagagttgttactggtttcttcagattttctattcatgattcaattttggtaggttgtatgtgactaggaatttacccatttcttctaggttttccaaatagttgccttatagttgttagtaataggctcttatgatcccttatatttctgtaatatcagccataatgtcaccttttcacatctctgaatttgaatcttttccttttaaaattttgtctagctagaaatttgtcgatttttatcttttcaaaacactaactcttaatttcattaacgttttgtatttttaagcctctatttcacttatttctgctatgatctttatcatttctcttcttctattaacttaaggtttattttgttctcatttttcctagttccttgaggaataatgttattggtggtttactggagatctttctcacttactaacgtagacaattattgctataaacttccccattagaactgcttttgctgtagaccataggttttagtacattgcatttgcattctcatttctttaaatttttttttaatttcccttttagtatctcctttgactcatttgtagttcagaagcatgttgtttaaaaactatttgcatatagtttctaaagaacctattattgatttctagtttaatcccttgtcacaaaagatactccccaacttgaaattttgtttattattattattattatcattattgttattatttttgagatggagtctcgctctgtcacccaggttggagcccagtggcgtgatctcggctcactgcaagctccacctcccaggttcaagccattctcctgcctcagcctcctgagtagctgggaatacaggcgcctgccaccatgcctggctaaattttttgtatttttaatagagacagggttttaccgtgttaggcaggagggtctcaatctcctgatctcgtgacctgcccaccttggcctcccaaagtgctgggattacaggtgtgagccaaggcccccggctcccaatttgaaatttttttaacttattgagacttgttttgtggcccaacacatgacatatcttaaagaaaggtccatgtgctaatgaaaaaaatgtgggccaggcgtggtggctcacgcctgtaatcccagcactttgagaggccaagatgggtggatcacctgaggtcaggaattcgtgaccagcctgaccaacatggtgaaaccccatctctactaactacaaaaaagtagccgggtgtggtgacacatgcctgtaaccccagctatttgggaggttgaggcaggagaatcgcttgaactcgggaggtggagattgcagcaagccgagatcgtgtcactgcactccagtctaggtgaagaatgaaacttagtctcaaaaaaaaaagaaaaaaagaaaaagaaaaaaatgtgtattctacaactgctgggcagaatgttttgtaaatgtctgttaggttcatatatcttgagtgcagtttaactctatcgttctttgctgattttctgtctggttgtcctatccattgctgaaagtggagtgttgatgtcccctataattacagtattgctatctctctctccctttagggctaataatatttccttcacatatatacatgtgtatatatacacatatatacatgtgtatatatacacatatatacatgtgtatatatacacatatatacacatatatatacatatacgtatacacatatatacatatatacatatacgtatacacgtgtatgtacatatatacgtatatacgtatatgtacatatatacgtatatgtacatatatacttacatgtatatatacatatatacgtatatacgtgtatatggatatatacgtatatacatatctatgtatatgtatatatagatacgtatatacatgtatatctatatataacctttcttcctctcttactatttatctgtctgttttggtggttttctggagagttaagctttaattcttttctctttcttatttatgtatctgctgtcgttttgttctttcaggttactatggggcttacattttaaaatcttgtatttataatggactattttaaacagataacaactttgcatacaaatacgctagacttttatccccatccccccacaatttataacttgctgccttaatttacatctttttaaaatcatgtgttacttaacatttaattgtagctatagacatcacttaccattttgagttataaccatcatactagagatttaaaagactatatgccaccattacattaataatatattctgagtttgaaagtgaaattacctctaacagttctaaattggattctgaattgacttctaccagtgagttttattcttttgcatatttttatcacggtagttatcttaccatatttcttgtgtccccgtattgacctgtgccattaggtgaaacagctgcctcttccaattttatggggtaactttcttaagaagacattttctgtagatggatcctaaggtggtaaatgggtagggtgctttagctttggttctaggtaggtgcagcagtgtagtctctgtgtaatttctttacctgtagtcaacatccgatgttactgcctcagtgacttaggctacgggtgtttacaaagttggtgtgcttttccagtactatgttggtgccaccaagcaagccagtcctctggtcctggggggcatgcgcaaggcatgagtgacagttccaagccatgcaccgtggtatatgcctataatcccagcaacttgggaggctgaggctggaggatcacttgaactgaggagttcaagtccagacagggcaacataatgagaccctgcatatttttgtttgtttgttttaaagtgcagtgggccagacacagtggttcacacctgtaaccccagcactttgggaggccgaggcagaaagactgcttgaggtcagaagttcaagacaagttcaggcaatagagtgagatcctgtctaccaaaaacagaaaaattagccgggcatggtggtacatgcctatatttccagctacttgggaggctaaggcacgagaactgattgagcttgggaggtagaggctgcagtgagccacgatcgtaccactgtactccagcctgggtgacagtgtggctgtggggaaagccgccacacaagctatcttgatgccaagggtgtatgtccaaagcatggttgttctagcaaatgaaaaggcagtgtcaccaggagcagagctaccagacagcctggccctcagaccctgcagggtacacatgcaaagcatagtggttctgtaggtttcagaggtggcatcattggatacacaccagtccactggctctggaaggcacacacaaaatgcaccagttcagccagttgtagggacagcgtcatcaggggtggggatgctgggtgggctggccctcaggacctgggtaagagtacaaatccactcatcatgggggtggcattggcaagagtggggccaccaagtgggcccatcctcaggccctcggggagggcacaaatccaatgatcacaggagctgcactgtcaggggtggggctgccaggtaggctgatcctcaggccctaagacatttctttggcaaaatgtcttttggctatttttaaattaaattatttgcttttttgctattaagttgtttggactgcttatatattctagacattaacccactgccatatgcatagtctgcaaatattttctcccatttacagtttgtctcatcattctgttgattagttcctttgctgtgcagaagcttttgagtttgatgcaatcccatttgtctattactgctttcgttatctgtgttttgggggtcatagtcaagaaatcaacagccagaccaatgtcatagagttttccccgtatgttttattctacaattgtccctcaatatccatggggattggttccagaaccacgctgagataacaaaatatgtacatactcaaatcccatggccggccctgcagaacccacaggtacaaaaagttggtcctccataagggtggattttgcatctcacaaataccatattttgatccacatttggtcacagatgtagatccccctgatatggatgactgtatttattttttttaaacccatgtataagcggacctgcacagctcaaacctgtgttcaagtttaacagtttcaggtcttatatttaagtctttaacctacttggttggattttttatgtggggtgagatatggtcccaatttcattcttctacatgtggatatccagttttcccaacatcatttattgaagagactatactttactcattgtgtgtccttggcacctttgtttaaagtcaactaaccataaatgtacgggtttacttctgagcttttaatacttttccattggttaatgtatattttcttctgccagctccatgctgttttgattacaatacctttctaatatatatatatatatatatatatatatattttttttttttttttttttttttttttttttgaggcggagtctcgctctgtcgcccaggccggactgcggactgcagtggcgcaatctcggctcactgcaagctccgcttcccgggttcacgccattctcctgcctcagcctcccgagtagctgggactacaggcgcccgccactacgcccggctaattttttgtatttttagtagagacggggtttcaccttgttagccaggatagtctcgatctcctgacctcatgatccacccgcctcggcctcccaaagtgctgtctaatatatttttaaatcaggtagtgtgagcctccatccagctttgttctttttgttcaagattgctttggctatttggggtttttttgtgtattcatatgaatttcaggattttttttatttctgtgaaaaatgaaaatggaatgttatagggattgcactgaatcagtgaatcactctgggcaatatggagattttaacaatattaatttttccaacccactaacacaggatatcatttttcatttgtgttgtcttcaatttctttcatcaatgttttatgatttttttgtatacagatttttaacctctttggttgaatttactataaaatagtttatattttttgatgctattgtaaatgggatggtttccttaatttctttttcagatagttcatttttagtttataaaatgctactgatttttaggctgggtgcagtggctcatgactgtaattctagtactttaggaggccaaagcaggaaaatcatttgaggctaagactttaagaccagcctgggcaacacagagaaagaagattccatctctacgagaaaaaaaaaaaaaatttaatagccagatgtggtagcatgcacctgcagtcctagctactgaggaggctgaggtggaaggattgcttgaacccatgagttcaaggtacagtgagctacaatcatgccactgcacttcagcctgagtggcagagtgatacactgtctctattaaaaaaaaaaaaaaagcaagaaacactgctgatttttgtatgttgactttgtatcctgaaacattactgaagtacattacggaatttatatatcagttctaacagctttttagtggggtcttgaggattttctatataacattatgttgttgacaaccacaatatcacttcttccttttgaatctggatgccttttatttctttttattacctaatttctgtggctaacaattccagtaatacactgaattgaagtgtaacagaagtggtgacagtgggcatccttttcttgttcctgatcctaagagtaaagctttcaacttttcaccaatgagtataatgtcagctgtgggcttgtcacatatcgcctaattatattgaggaacagtccttctatacctaattcgttgagcttttatcatgacaggttgaattttgtcaaattctttttctgcatgtgttgaaatgacagtatggtttttgctattcactgtgttaatatgataaatcacatttattgatttgcatatattgaaccattcttgtatcgcaagaataaaccccaactgatcatggtaaatgatcctttcaatgtcgtattgaatatggtgtagtagcattttgatgaagatatctgcactatttacaacagcaaagactactgtgaatagtgctgcaatgaatgtacaggtgcatgtgtttttggtagaacaatttattttcctttgagcatgcacccagtcatggcactgctgggttgaatgggagttcaactcttagttctttgtgaaatctccaaacttctccgtagtagctgaactaattttcttgtagtactttcgtatggctttgctatcagggtaatgctggccttataaaatgagtttgaggtattctctccagttcaattttttgaaagagtttgaataggactggtattcatttttatttaaatgtttggtagtgttgcatcatgaaactatctggtcctgggctaatcttttatgaaagaatttctattgctggccaggcatggtggctcaatgcctgtaatgtcctgaagaatgtcctatgtatgcttcagacgaatgtgtattctgctgctgttgactgaaatgttctgtatatgtctattaaatgcatttggtccactgttttcttcaaatccattgtttccttattgatttttggtgtggatggtctgttcattgttgaaagtggggtactgaaatcccctaggattactgtattgtagtttatctctctcttcagatgtctcaatatttgcttcatgcttttagatgctacaatgttgggtgcatatatatttaaaattgttacatccttttgatgaccatacccctttttattattatatgttgaccttctttatctcatctacagtttttgactttattttgtctgttataaggataactactgttgctctctttaggttttcatttgcgtgggatacttttttccatcccttaatgttcattctctgtacatcgttaaagctaaagtgagtctctcgcaggtagcatatagatgagtctctctttttttaatgcattcaggcactctgtggcttttaattggagaatttaatccatttacattcaaaccagttattgataggtaaagatttactagtgccactttgttcattattttatcattttgtagagcctttcttccaataattctgtcttccctttgtggtttgatggttttctatagcagtatgacttccatccttttatcttttgtgtatccactaaaggtggtcaccttgaggcttacataaaaagccagtcatatacttacaactggctattttatgcttacaaaaactaaactttcattgcatgcataaaccctacacttttactcacccttcatgttttatctttttgatgttacattttatatctttttataatttgtgtcccttcacaaactattgtagctgccattgtttcaacagttttgtatttcaacctttatactagagatatcattgatttacacactggcatcacataattaaaatgtttgaattagacagtgtacttacttttatcagtgagttttctgctttcatgttctcatggtactaattatcactgtcctttagcttgaagaactttctttagagaactctcaagaaagaagttcaagaaagtagaactctacttgtaagtcaggtctagcagtgctgaattcccttagccatcatttgtctgagaaagttgttatctccttttcatttttgaaagacaaaattgctgggcatagtactatggttggcaggtcttttttctcagaggattttgaatcccactaactctggcatgcaaggtttctcatgaaaaatctgatgatagtcttgtgggggacccttgtatttaacatgttgctttttcattgttgctttttaaaaaatactctgtctttaatttttgacaaattgattataacatgtcttaataaggatctctttggatggatagtattcggtgtcctttgaattttctagatctggagttctatttccccaggcttgagtagttttctgcctttacatctttgaaagtgttttctctcactttttctttcttctccttcaggtattttttgaatttatcttgtttctctatttggaacatacttccccatttcttcatttgcctttaccctctgtgttgttttctgcacattagataacctaatagcttctcccaatcttgtttagtgtagaagaacctaaccagtcagtctggccagaaattctagggtacctctcaaacctttgtgtttgtccaaactgctgcctttgttttttgttgtctccaggaaattaggatgtgccaagttccgttagtacctcaaaagtctggccagaaattctagggtacctctcaaacctttgtgtttgtccaaactgctgcctttgttttttgttgtctccaggaaattaggatgtgccaagttccgttagtacctcaaaacatttgagagagaagtcattccccctagacacagctagaaaggttgaagtgttaagtgtgttccagttccttctatcctcgtggtgaagctgacagtaggattctctctgcactacgctgaagagaggaattctagcaaacgtctatattttagatcagactgcattatctcatcttgggggaaaaaagtgggcccactgaatgcccatttatttgttttcagtggtctagagactcagaaattcagtgtcccatcaattcccagaactataaggttaaggcggctatcccttgggagggagcagtggcagctgtgatcaatccatgaataaactccttccaaggataatctacagagataatctgctctagctttattgctggagcaagccagatgaaaaaactcaggaaacgctggaactcacagtcagtatcccagggttctgctgtttctttgcccattggctactagatgcagcctagagaggagcccaatcctcaaacaatggctagagaagtatacagacaaaccccttccagaaattaactggggagtgtgctttttaactgcttatctgcattgatccagggggctgtagtccctggaaatgtctgtgtgtttaaaaccacctctttgttctctgtcactgcaattcatattttctaagatttatatacagtatctactactgcatgtaattattttgagattcattcacgttgttacacgcatcaatagtttattcatttttattggtgagttaagtattcaattatatggatataccacagtgtgtttatccatatttctgttgatgaaagtttgagttgcttcaagttttttgctattacaaataaagctgctatacacattaataaaacaaacaaagcaaaatgaaacaacaacccctgcaaaaaaataaaaaaataaaaaaaaaccagagctatattaacagaggggcaagtactgctcaccaaatcctgcccactatttatatattgtttatatgggttaaaataataatattttatggcatgtgaaaaattatataaaattcaattttcagtgtccattaacaaagttttattggaatgcaaattatagctgcatttctgctacaacagcagagccaactagttatatcagaaaccataagcctgaaaagacaatgtccctttatagaaaaacctggcaaacatttattatagataattggattaggtgagcactaatcagaaattattttaaaatcaggtaccattcagaatttgaccttaacttggctcaaggagaaatgaaaagaccttacataaagaggcaataactaaacaacatttatattcaggagctattaaaacgctagaaaatggtatatatcacaaataaatatttacctgaaccattaggctcagccatttcataacagtgttatttctaaaatggattcaactaagtgcacgatcactatcttggatacaaataaggttatttcttgttttttgatgtatgaagattgtatgagtaataaaaaataattgtgtagcagaataccaatacaaaaaaagttttcatagtactcacctttggaagggcaggcttggatttgaaatttttgtttctcctatagagataaatcattcattaaaaaaagctactgtataaaaacaaaaacaaaagctactgtagagaagaaagatttcaaggtctctcctaaaacaacagattatatacccattaccaagactgtaggttctttatatgaaaacactatctgattcagccaagcaggcaccttgggaaggaagaataaacaaggaaaagatacctgccttgttatataagtataaacagatttacacctgatgattagtaacactgtgttgtacattctaagccacaggttcattttcttcagttgttagtagtttcttgtacctacagaagacttatttctatcatatcaaaactaaatgagatgtctaagtttcataaattttaaaaaaacgtacttatcaccaaaacgtaatcttccatttttggtaattaaaaattctattccactcatttttttccttattcaaacctcaataccatacttaaatcaagtctttttaatttatttttagccttttttatggccacagaaaagaaggaataaagtccaacgcttatgaatatgggctgggaagttagaaagacctggacaacaatctatggtctaccatctattaaggtatgattttaacctctttaacttttcattatgtaataatgtaaaacagggaggacaatactacctataacttaaaagttgttgtgaggattaaatgagttaatgtatatctctgggctagagcaagacctacataaatagaacctactaatattattaagcagtgattcagacaaggattatggaatccaattcagtcacacctctagctagcggtcaaacgatatgcttgggaaatatctaaaacatgttaatgctaataactaataactttttttcctttttttttttttctcagagacaggatgttaatcggttgcccaggctgaagtgcaatggcaagatcatgactcattgcagcctcaacttccttggctcaactgatcctcctacctcagtctcctgagtagctggaactacatgcatgcactaccacacctggctaattttttttcttttcttttctttttttttttttttttttttttttggagagatggggtctctatgaagcatggtagagaatggttatagctatgtcttcaaaccaactctgtaatcagttaatgagaaatggaaagcttggataagtgttatatatcactcaaccattcaccatttatagattttcttgcctaatttgttaagattgctagaattaatggataattatagtaaaaattgggaatcctaaaaggagctaacagttttttctttctctgaaggtagggcctgtctaaacaataagacctttattatcatctccataacaaatatactcagtcatgattctcctggtaatatgggggagaaaaatcaacaaaaacacaagctttataacacatgagattcatggctgtaaacgctacctaaataactttgagtcttgtttcagtcaaaattcttcccatgaaaataacatttcaccatcttccttcttcatttttttctgccagaaattttaaaccagacaaaaaacaaaaaacaaaaaacaatttacattactgattagtactgacgtgagaattccatgggctctctccaggagtttgctgctagttgaattagcaaatattccatctttatcaagcaaggaggtgccacttgatagtctgctctggcgaatcccagttctgccattccaggcaatatcaaatgtatcactgtaaaaaatataatttgctttagttaatgaagacgtctctaacactatactgcttaaataagtaaaataaaactttaaatactaaagttaaaatttagaaaaaaatgctaaaccaaccaaaaactgatttcatccaaatgactgccaatcagttgggactaaccgttgtctcattcagaacaaattcctatgaattccatcatattcacatacaaacgtgcatgtagatgagcatatcatgtagctgatatctttaaatatattatcattcaacaactagtaactaataaaatggattatagtatcttccctctttgttagattttagaattttcaaatgctactataggaatttgtcatcctaatacactatcccatcctatggaatatctaatttcctcctgaaaggtcttatttacacacacacacacacacacacacacactcactactcacacacccattaaactaagtcctatgagactctaaacattgcagatatagcaatgaacaaaacataacactatcacagtgattgtaacatcataattaatggaggactcaccaggtaaagtagtagtatccaacaacaaatgaatggataaagaaaatgtggtatatacatacaatggaatgctattcagtcattaaaaaaagaataaaatcctatcatttggacaacatggacaaacatagagtacattatgttaactgaaataagccagacacagaaagacaaatactgcatgaccccactcgtatgtggaatctaaataagctgctctcacagaagtactgaatagagcagtgattaccagagactggaaaaggtaatgaggtggaggggtgcagtaagcagagaggttggtcaatgggtacgaagttacagtaagacaacaggaataaattgtggtcctctattgcacaatgaagtgattatagttaacaataaggtattgtatacctgaaaacagctagaagacagaattttgaaagagaaatgttcccaccacaaaaaaatgacacatatttgagacgacgaatatggtaattattttaatttgatcattacacaatgtatacaggtatcaaaacatcacactgtacctgataatatgtataattattatgagtgaactaaaaattttttaaaagaagtatcaggagatagctacttacaacaatttcacatttgtccatatttataaatctcagcttccatttgcttagagcatttattcaagatatataaatggcatgtaatcaataaaccatttagaaacgcttgtattttcattattttgtgctaaaccattaaaaaaaagtcagtgaatcatcatccctaagataatgtgtcttcccaaatgggagaatcatactgcacttaagatggtttgtgtgtgcacttatatttttctcatttacaaaaatgagtggtactctggctttagaaaaaaaaaaaagaaaacaaaaggagagagagaggagagagtgagaggaaggaaggaagcaagtgagggaagaaggaaagcaggaaggaaggaaaaacgaagggagggagggagggagagggaggaaaaaatgcagtaggaaaatacattcctggtgaagatactgtgaaaagtgttgaaatgacaacatattctgcagtagggactgtgaggaaaaaattcttttaaaaaaagaaaacagaggattcaaagcattatagaaattgagttgataaagcagtggcagggtttgagaggattgactccaattctggagttctactgtggataaaaggctatcaaacagcattggatgctacagggaaatctttcctgtaaggaagaggcaactgatgtgcaaatttcattgtcttattttaagaaattgccatagccactccaattttcagcatccaccaccttaaacagtcagcagccatcaacatcaaggaaagaccctctaccagcaaaaagattatgactcactgaaggctcagatgattgttattttttttagcaacaaagtattttttaattaaggtgtgtatgtattttttaaacataatactattgcacaattgacagactacagtatagtgtaaacataacttttatatgcactgggaaaccgaaaaatttgtgtgatttgttttactgagaattcgttttattgtggtggtctggaactgaaccagaaacccatatagatcacttcaggtatccaaaatggaaagtacaaagaaagaagcacaaactagaaattaggaaacttaaaaccactaaactgctttgtgaaatgaggcatattgcggtttcttttttatataatcaagaaaattgggttcccatctgatgaccagggtgagaatactgccaacagatgaaactgaaggtacacaggtcaaggttaactatctaatttgtgttcgggtaaaatttaacatgcaaatatggtggtagataccatagttagccaaatactactgttaagaaaacaaaggacatacaatataaagatagcaaatagcttaatttgtggcattcaaagtgaatatatttgtggctagatacttgggctgtgacagatcttgcatatgaagttagtgaacctagacttttaaataagcaataaagagtcatgaaaaagttactgagcagacaagtgacaattatgtattagaaagacacggtgactcaattggaaaaaatgatcaatgaagttataccttcattttaatgacagaccatccttattaccacagtattaggaagctcaattttttgatgatgtttaaaacatacagaatacattctagaaacaatgttctcctcatacaaattacaatctttattaaatagtatatataaaaaacaaaattttatgaactcataaaattatttatatttgttactgtcaaattgttctcaggaattcatcattgaaaatagtaaaaggtaagctttggtaatcgcactcacccaaaaaaggtattggatggtttgatgtaaatcaaactattcaattattacttcccaataagatttctccacagaaagcagcggaataacccttaaattttgtaaaagacataaaatgcaagaagggtctcagcaattaaaatatatgagctcattttaagttattctgaagaaactttttcaaaattgtaaagccattttaccagaagcaactgtagacaaatcttgttaactttaacctattaatgtgttattacatcacttataaaggattcaagaaataaaaaaacaaaacaagcctgaattacttcaaacttttaaagtcacaaaaatatcaataagaatgttagttatttcttctatacgtccttgaaaacataaaccaaacacacttactgttggtttttttcatttagagcattcatgccctggagatcagaaagaggtgttctgggatttttccgggttatacctagcaaaatttaaaaaacagaaaatttcaaatcagtgcaaagaaaaatgaaacgtgaaatagtttttctaaagacaaacgaaaatttaatcacgagtatttgctaaatatttcagaaatatctaaataattacatgacccaagtctcataactgtcatagatcttagttaacaatgaacccaattagaaaatttaataatgaaatattttcttctttcattgaatcattaacttcagaaaatacaagggtgactggactgaaggcctagaagtgtacaagttcatttttatttttaggttcagggggtacacatgaaggtttgttacaaaggtaaactcatgtaacgggggtttgttgtgcagattatttcacccaggtactaagcccagtactcaatagctattttttctgctcctctccctcctcccaacctccatcttcaactagacctcactgtctgttgtttccttcgtgttcataagtttttatcatttagctcccacttataagtgagaatatgcagtatttggttttctgttcctgcatttagtttgctaaggacaatagcctccagctccatccatgttcccacaaaagacatgatcttgttctttttatgactgcacaaattcatttcttattttgatgcatcattttttagccatacatttctgacatgttcagataaatacaatgagtatcaatgtattgagaattaatgttataaatacgatgaatataaaagaaattgcttccttaagaattactaatatttaaaaaatgtaatgttcttcaaatcatatgataaacatgtaagttccgtaagcataaggctatcaatttttataacacacaaacatgtaatatatgtaagatacactggaaaaaggaagtaaaagtatctctactcaagatgacaatcttgtaggcagaaaatcctatggaataatttaaaaaaactgattcgactaataaacgagttctgcaaaactacaagaaacaaataaatatacagtggtggccaggtgtagtcacagatgcctgtaatcccagcactttgggaggccaaggcaggcagatcacttgagctttgtagttcaagacaagctgggcaacttagacttcatctatactaaaaataaaaaatacatgtaagtgcttagaagagtgcttggcacatagtcaacactatatccacatgaagtgattgttatctttctgtatgaatgagggaaactgaaaacccacagaagactctttgtgctgtttaaatcatgcaaatgggccaggcacagtggcccatgctggtaatcccaacagtttgggaggccaagacaggcagattacttgagcccgagagttcaggacaagcctgggcaacatgctgaaaccccacctctataaaaaatacaaaaattagctgagtgtagtggctcacacctatagtcccagcttgagagtctgatgtgggagaactgcttgggccccagaggtcgaggctgcagtgagctgaggtcgtgccactgcattctagcctgggtgacagagtgagaccctgtcttggagcggggacggggttgggggaggaggggcggaaatagcaataaatattctgaaatgaaatttttaaaagtataaaatgtctacattgaaaactataaaacatcattaaaagaaaataaagactcaactaaatggaatactatctatgtgcctgaattggaaaatataatattgttaagatgtcaatgttccccaaactgacctacagatcaatgcattttctattaaaattccagataattatttttgtagaaatgaatgagccaatcctaaaattaacatggaaatacaagggatccacaagagctgaaaacaatcttgcaaacaatcttcaaggaggatggcttgagtccaagagttcaaggctacagtgagttatgactacgccatctcaccccagcctggatgacagaggaagactccatctcaaagaagaaggaagaagaaagaagagacagaagaaaggaggagggggaggaggagtaaatttctagacaatagattaggcaatggttaccatttttacatcaattattaagtattttaaacataaaagtggcctaaagaataatatactaaacacttatgatggatcactcagattaaaaaatgaagccctgtgtagctcactccctgatcccatttaaaaatcatcagatctggtcaggtgcagtggctcccacctgtaatcctagcactttaggaggccaaggtgggcacatcacctgaggtcaggagttcgaggccagcctggctaacacggtaaaaccccatctctacaaaaatacaaaaattagcccggcatggtggcacacacttgtaatcccaactactcaggaggctgagggaggagaatcgctcaaacccagaaggcagaggttgcagtgagccaagatcgcgccattgcactccagcctggatgacagggcaagactccatctcaaaaacaacaacaacaacaacaacaaacccatcagatcccaagattgcccatttgttcgaattagcaaaaaaagcattttaaaatagctatcttgagatggtatcaaatattctaacaacatttgtaactggagtttcagaaggaaaaaagaaattgtagcagaaaaaatttttgaaaaatattggccaaaaattttctaaatttgatgaaaaacaatgaaagtccaaaaggtacagcaaatcccaaagaaaattaatataaatcatatttagggacatgagaatcaaattgctgaatgccaaatatgaagagaaaattttaaagtcaaaggaaaaaaaggtacacgacatatgaaggaatgacaatgggatgacaatctgagtaatcatcacaaataaagccctaagaacatggaacatctttaaaatgccaaaaatttgatagtttgtaatgatgttaaacatatgcctacttcatgaagtaactccactcataagtatttactgaggaataaaaatatatgtctgcaaaatgactcaaaaaagaatgtttatagcactgttgttcacaatagctctaacaatatatataattcttaactacaccaacaaatcaataagcacaattatatacattatatataatcatataaattaaatacaatgtgtgtatatacatatacaatggaacacacctgagcaacaaatgatatatggaaaaatatgtatgaatacatgcataactatgttgcataacacaatcagaacacaaaatacatactatgtaatcccacttgcgtaaaatttttagaaaatgtaaaactgacttatagtaataaatctgtggttacctaaaggaggtgggaaaatgtacaagagaataaggataaattttgatataactctttcctaatattcttaatttctttgtgtttatatgctttaggtttgtctcttgtaagcattctacagctaaattttgctcatcttccttaatccataatgttttttaaactgttcagtttagtccattttaacttactgctataattgatacatctggaatttttttctgacatcttagtttatatttttttatttaccttaactattatatgctttcatccaggcttctattgttttctttgtactttgacttcttttgttccacaaattgtatactttctgctttatttatccttaaatgtttaacatactcatgaattctaaactaataatctgttctctttctctaaagagtacaagaaccttcaaatgttttaattaaagtcatccccttctcattagggatgttattgctacccaatacttacattcaccttgtttcttttccttcatcaagcaaattaggtataagttttataaaattgttgcttatttagctttatatatacatttaccaagttctttattaaatatcaaaactttctagtgggttcagcttctatcttgctcaactaaatttttaaaatctatataggtgagcatctgttcagattactatctagctttaataattgctatcattcatatttgcctggtacatcactgtccatccttttattttcacctctttaattaaaaatcatgtagctatcacttaaactactgaaaaattcattgagagtttaactggtgagtgtaaaccatttatattaattttaaataatacttgtttctggcatttcatttcatgtttttcatttatttcactctttcatttttttccttcttgattttcactttataaggtctcttatgctaccttaaaagataaaaattgttattactgtggttgtccttaaggtacacgttcaatttatttaattatactgatttcctaaacttgaaaagattatgttaattcaagagcagtagagctccccgctttcccttcagttttcaccaaaatgcatgccagtatcttctatatttgtctctgtataccatctgcaagcagtaattctgatcatatacaattttttattttggatattcttagtttcatgaaaaataatctcttctaggcatttacttgtaacttgtatcaggcttcataacatgtaattaaacatttttattggaataaaaatttcaaagttaaacatatatatgttaaatgtacagttaaataagttttgctaaatgcattcaccacactaataaccaccaaagaaagatacaaaacatttccatcatcaccaaagttgccttatgccccttcttggacaatctcccacacttacttatgggtaaagacaatcactaacttgctctccacacagattggcttgtattgactagaactttatacagatggaataaaacagtatgctttgaggataggccttcccttagcataccactttagagattcatacgtaaaagtcttttgtgaatatatactttcatttcttaggtaaataactgagatttgaattcatgaaacatatgggaaaaatacgcttatctttataaaactgacaaactgttttcggaaataactgtaccatttgacagtgccaagagacagtaggagagctccagttgctccacatccttatcagttcgtatttcaacttcttacattttagccactatagacgtattagtgaccttagtcagattacaatttgcctttccataatgaaaaagttgaacatctttcatgagaacacagataaatcttcttttgtggaagtgtatgttcaaatcttttgcccatttaaaaactggcctgtttatcttattattgtaggagtttttatattttgttttcaagtccattatcaggtatgaatattacaaattgtaataaatactgtttcccaggctgtggtatgttttttgttttcttaatagcagttaagaaaagtagttttcaaattggctaactttaccaatttgttaattttttccttttatattcatgctcttatgtctcatctaagaaacttttgcctgtcacaagattacaaaaatttgtttctcaggttttcttctattttaagacaaatttaatagttttggtccttacatagagctgtatgacacatttcaaaattaacttacatgtatgatataagggtcaaagttctcttataccttatggatatccagttgttctagtgctatttgtttaaaagactatcccttacccccactaaattatcttggtgccttaacagaaaatcaactgactgtgtatgtgtagatctacttctgtactttgtatttggttcattaatccattgatccttaacaccaatagaacaatgtcatgaatattttagtcttaaaatcatataatgtaaattatccagctttgttctgtttaaaaattgttttggacagtctgggtattctacatttctctataaagtttagattcagcttgttaatttctaccaaaaaatctgctattatacttattgggttgaattcaatctatagatcaatctgagagagagctgcatctcaaaaatacaaacataaatatgtatctctcttcattgtattcttcagtttctcctagtagtgcacaactcttaaacatatttgttaaatttatccccaagtatttcatgtttctgttaattatccactgcatattaaattactccaaaatccaacactttaaaacaagttatcatctcatatagtttttagaggaacaacaattcaggagtggcttagctgggtggttctgactcaacatgtctcaagaggttgtattcaagctatcagccaaggctgcagtcatctcaacattggaatgaaggatccacttctaaggtcactcacatagttggtgacaagcctcagttcatactgagttttggctactcacaaatagcatcttgtctctccaagagacagtgatttcagagaggcctagcaagtaaagcagtaccccagaaggaaattgcagtcttttacagaaatcgtaaaagtgacataccatcatttttgccatgtgctttctgttacacagaccaactcttgtaaaatataggagaggactataaaagcttgtgacatctaggaggctggctgccatagatgtacagtacatggaatttgtaaatcattttcttagtgctcatggctaggatattacaattttctataattacttggtatcccgtaaaaatgttaaactcactttttagttttaagagcacttttccttaaataggaagtgtgattccttcacacttcctatattaatgaatttgttgactacttcttttcaatctatgtacaatttctttttgttgcctttttgcaccacctgtgacctttagcaaatgtcaaatttaagtggcaaaagatgtctttgccttgttcttaatgttagggaaaaagtattcaatctttcactaataactatggagtttgctgtaggattttcatgcatattcttcataaagtagaggaagttggtctctattcctaggctactaaaagttttaaaatagaatgagcgtggtattaagacaaactttttctccatctactgagacaatcatatgtggctttctttttatatggttaacatggtcaagccaacctttctcatccctggaataaattccatgtggtcttcatgtattattcttcatgtattatctttaatatattgctgaattcagccagctattattatttctatatccaccattacaaagttatattggtctatagttttcttataatggttttggtaacagaataataacactggcctcatgaaatgatttggatagtgttcccttctcctgttttttgaaagagttgaagagaattggtataatagtcatttcttaaataaaattactaatgagcctatcttggcctaaacttcgtgtggggggaaaattttagttaagaattcaatattgtaaaaagataccgcactattcatattttctatattttcttgggttgattttaataaccgttgacgttcaaggaatttttccatttcacgtaagttgaactgattgccataaatgttcataatctctttgtcaaacttttgatttctgtagcatatataattgtgtccactctttcattctaggtaatagctttgtgtcttctctcacttttctagatcagaatagctataactgcactatccaatacagtagccactagctatatgtggctatacaaacacattaaacaaaattagaacttcagtttcagctgcaccagacacagttcaggtgcttaacagccacatgtggctagtggctacagtactgacagtgtagctggagaacatttccacatcgcagaaagttctactgcaccatgctggcctagagatttatcaacttcattgttcttttcaaaaaaccagctttaggccggatgtagtggctcacatctgtaatcctagtactttgggaggccaaagcaggaggattgcttgaagccaggagtttgagaccagcctggacaacatagtaagactccatctccacaaataaaattttaaaaattagcagggcatggtggcatgcacctgtagacctagctacttgagagactggggtgggaggatcacttgagccaaggaggtcaaggctgcaataagccatgattgtgccattgcactccagtctgggtgacagaacgagctcctatctctaaaatatgaaacaaaacaaagtaaaatggtggcatgcacctgtagtccgaggtgcttgggaggctaaggcatgagaatcacttgaacccgggaggtggaggttgcagtgagccaagatcatgccactgcactccagcctgtgtgacaagccagactccatctcaggaaaaaaaaaaaaaaaaagttttatttactttacttccttttacttatttggagtctaatatgctcttttcttcctagcttaaggtgaaagcctcaatcactgattattttaccttacttttctaatttaagaatttaaagctgtaagttttctcctaagtacttctttatttatattccctaagttgtaatatgttgtttccatcatctttcagatcaaaaaacttccaagttacccttatgaaattttttcaactcattagttacatatacattttatttttcaaatatgtgagggtttcccagatatatctgttaattgatttgcatttaattccattttgatcagacaatccactaaactttcaatcatctgaatgaccatcctgatacctgaggttagggacattaaagtaggcactgtcagcatggtgagggtaatttaggtggagtaagccctcagcccttccctggcaattgctgatccttcatcttgctgatgcacatcatattctcaatcatcccaaacaggactgaaggccaaaagaatgggttcaaattaaagttagattcttcttttctacccctgctctccttctgccatctgattccttctttctagggctcctgtcatttctggaagtgagctgtagctcatgctccccaaaacttcaatttttcctcactcctctaatttcctccctgagaaatttcagagaagagccactttggagagaaggcgagagcaccagaaagaaagagaaggaggaaaggccacaatacctttatgtcttaatattgaaggtcacacactgtaacttctgccacattccatttcttggaagcaagtcactaagtacaggacatgccttatgaagggggcagtatcaatttgtggacatattttaaaccaccaaaataatgtcagattttttactttaaacagtcatttttttaattaagagaagccaagaaaatatgtgtagtcatttatatttttatacatatttattagttctgccttctttattccttccagtaattcatgcatgtatcagcaaactagagtccatggcctaaaccaaacccactgcctgttttttgtatgacctatgacctatgaatggcttatatagtttttaactgaggagaaaaaggagaacatttttgtaccatgtgaaaattgtttgaaatttaagtatcagtgtccataataaagctttattggaacacagctaaactcatttatttatgtattgtctatggctcccttcacagaagagatgagtagctgcaacagaaaccatactggcctacaaagcctaaaatgtttgctgtctgctttttgcagaaaaaatttgccaacccctactatagacccaagttacgatcatggggtgatttccctcgagcctgaagaatttctattatcattttccatataatacatatgttgacaaattcccagactctgttagtctgaaaatgtatttcaccttcatttttgaaggatacttttgctacatgataacaggacattgtggataacacatcatagcaacagtggatactgttaggttcttctgaagattgttaatttttcttctgtcagttaatctgtctggactcaaactgcaaatacagaaattctggttcaaattttttttgtgagggggggggatgtgacatattaaacatgattttttgacaccttttggcctccattatttttactgagaagtcaagtgttaattatctcattattcccctgtatttaatatgtgtatcttttccaggctgctttcaagattttctctttatctttgacattttagcagtttatctataatgtgcctaggtgtagttttccttcgtatttaccctgctttgtggtcactgatcttcctggatctgtaagctagtgtttgtttgtttgttttgagacagtcttgctctgttgcctaggctggagtgcagtggtgtgatctcaactcactgcaacctctgcctcccaggttcaagcaattcttgtgcttcagccacacgaggaggctgggattacaggcgtgcaccaccacacctggctaaattttgtatttttagtagagacagggtttcactatgctgggtgtttttttgttttttttttttttaaccaaataagggatgttttctgccactgtcttcaaataattttcgacccctttatctctcatttcctatgggactccaattaaggcagaaagacttcagtttttcccacacaagctaagcacaggcagaaaatttcctcagtttttctaaaaagcagcaaacttgcatagctcagctattatagttatgtctttcaaggattatctcttatttgatttccacttttttttttttttttaatacggttcctggggtcttccctgcatactcacagcagtcgccagggatatgggcagagttcatactttaatttgggttttagccctttagcagctctctcagtcccaggattttcctcctaaaccccaagctgctctgaaagtcttctaacataataagccagtatggtggtggtggtggtggttttctatctctgaaactatgcaagttaggaaaccccttgtataaaaagctacaaattcacaattcttacccactgctttactacctttaaagaataaacttttccctactttctgcctacttttggtctttttccagtacttttaaatatttggttattttaaaaatttttttccaggttttatcactgttacttgtgggaggattcattcacctcaccaattcaccactacctaaagctggtagttccgttttttttaagaacaatttccaaaacttgaatctacagttttacgtataataaaatttataacgtgatacctttttataattagtatattgctaatactatcgtggaaaatggaataaattacataaaataatggaagagctccaacgtccacaaaagtagaaatttgcaagtgaacacacatagacacacaatttcttcatgcagcctatgctgaaactggtgccctcctattcaagatccatatgtagctggcatacaatcaggtctggggttgtcaggctgggtcatgaaaaaacaaagcaaataaaccatttgcaactatttaagagttaatagaaattaatttaagtgttccaaaatgttttatagactattttaaataatgtcccatggattaaaagacagaataggaagatgaataactggaatgaggatttgttacattcctcttagaaacaacagcaacaattaagaataattttaaggatgtctttttaaaacaaaacacttacctttgttcctcttaaaatgagaaaatactttaaatactgtttttcaaaacacattacacacttttgttttaaccaagacagcaatggcaattgaaaaagaatccacaacatttgttcttaggaattctacttatattctcctctcactgacaactggatagtaaaatttcatggaatttcaaccagaaaactgtgaaattagcaaactaaatcagtggtaatttattaaaagctcagaacagattatgtaggtccattatacgcaaattgctgagttgtctttgagtattttgaaggatccacttattctcacaatagcagtgcctcaataatagtaatcttacaactggcaaaagaatcaattttcatgcagaatgagtacaacaaataaagagcaagaaaggaaacggagaccaagggcatcttttcacaccaattttataaaaaagcaaacaaaaaagaacatgcaccatgattctgttattattcctcaagccaaaacattaatgcggtggttttgctctaaaccagacataggaaaggctggctgaagcactgcaatcaaactaagtggatttaccaatgatacacaaaaataacatttgctaatgttgaaatttcaagcataagcaaacagaaaaatcatccagatttagaaagggctatgacaaaactttttgggaatgctgaatatattcattatcttgactctggagataatttcatgggtgcctacatacgtcaaaacttaccaaattgttgtctttgcattcagttttttacttcaattagacctcaataaagttttttttgttgtttttttttttatgagcaggaaagaaaacattgttgattcctatccatcacttggctacttgaaagacaaatagaaaccaatccagtgactgtaaccaagtataattaacaatccaatgatcacaggcaaacagaaaagtcaccaaagttaaaaaagtatatcagtattttcaaaagaaagtactaaagactcaatagaaatattcaaagactgctcagaggtttatggaggccatgttgcccatacaatctatatcccaccctggtgtaggatgctcctggtttccatttccaaatggatatgtgataacagtttatcaggatttgtagccttactgtacttctcttccttgcatctctgcagaatctctaagctcctctggtggactgggtgttggagaaagctaaaactatccatacttttcaaaattgcacatggcgctgtatcatcatgtccttaggaagcaaaaaaaaacaaacaaaaaaaaaaggagaaaagaaaaagacattatataagcccaaaccaacagagaatcaaggacaatgctgccaactatttaagggtgtataaaaatgtatcaaataatagaggttatatgtgaatgtccaattattttgaggaaaatgcttaaaaataacaggaaaaaatacaggcatttttcagatattcaaagtgtccttttcagtactcaaagtattgttagttaacaccatactagaaatttctcaatacaagcaaaaattcaaaagcaatttgtatgatttattttttaaaaggacttatttttatcaggtctcaaatataattaacatatagttggcaacactgatggaaccccaaagagaaatatacccagaacaatttacttaaacaattctttcacaaatcctgcaattaaccacacttgtaggaattccaacaagtgtgtcaataatgaaaacatgaagaaaagcaccatagagcaggaaagcccagcagcacttctgtacttataaatttgaaaacaaagctgaagactctgtacctcattatcacttcttaggaaaataggatagaaatcagctaccagtgaaaaatagaagagagcacattcaagtaaagaccaaagccccagatcagtgttatttaaagtgagtacttaggaaataaagtgaatgggagatgagtgccataaatattagcaataaagagtttccaggctttagggtggtggttgtgtaacatttattcagagatcacctctagagttagggcataatgttcaaatttaaataagtttgcttttaaaaaacaaagtacataataatatagaggcaaattaagtaacacattaaaatgaactaaagttctattactgcattttactgtataattaggaatgagatacaacagaacaatctttggaaaaatctcatagcagaatcattttaaaagttaaacagtctcatactaattcaaagaggtttgtagggcatattttagtctcattctaattccctaaattggatttatatatccagagaataggcagccatatttggcaatggagagggaatctaataccataaatcatgtaatattatacacagaaaacaggcttttaaaaaataaagtgaatttgaaatatttttcataataaaagtaactaaactaataaaatactatattatttgtacaatacgaaaagtcaataggtacaaaggttgaatgtttcaaaaagagaagtataaccaagcttaacatcatttcttactcaaaagatacctcgataaacatactctgttctcattattaccagtaatccccccttgatggattgcttggagaaagaatgcttaggccttaaactccactgcacttggtttggcagtcagctgaaggggaccagttgaggaaaaaacacccagtgagttctagtcagactccattcaaattgtaaattgaagaagttatcactaaacaatcacgcctttcaacagctaatctgataatcagctagtcaaaaataattcaagaatattatgtgttaaagtattctgtataagagctcaggatattaaaatacactaatttattatgtagagttttaaaaaatcaatcaacattactacaaccaccaaactattttctatttcatctaataaactgtggcactgccatttaaaaatgggtatttttgtatctgtgactgctttgtctcaccaccatgcctagattagtttctttaacctctctcctgttctttcattctgctttctatacctttttacagttttgaacgttattttccagactgtgacataatttctaaatcttaaagtgatattccctgtttgttttatgtaccaaacccctgccaaggtagtttggtttcccaggatggtttatattttcagtggggattcttttctgaggagtctcatcaactgtttttttgttttgttttgttttgttttgttttgttttgttttttgagagggagtctcactctgtcgccaggctggagtgcactggtgcaatctcggctcactgcaccctctgcatcccgggttcaagcgattctcctgcctcagcctccggagtagctgggactacaggcacgcaccaccatgcccagctaatttttgtatttttagtggagatggggtttcaccatgttgagcaggatggtctcgacctcctgacctcgtgacctgcctgcctcaacttcccaaagtgctgggattacaggcatgagccactgtgcccggccatcatcaactcttttttctttttttaagatggagtcttgctctgtcgcccaggctggagtgcagtggtgcgatctccgctcactgtaacctccgcctcccaggttgatgccattctcccacctcagcctcctgagtagctggaactacaggcgccagccaccacgcctggctaattttgtttttgtatttttagtagagacagggtttcaccgtgttagccaggatggtctctatctcctgacctcgtgatccacctgactcggcctccaaagtgctgggattataggcgtaagccaccgcacccagcctactcatcatcaactcttaaaagagatttatttagtatttgcttatgctagttgctggactggttgtgatgataatttcttagtttgacattatgcaccaaacacatagtataaattcagaccccatactcatatatggtgcagatgtggggcattgatttttttaaaggtaacttctttttaaccttatctaaggcctaacacagattgctaaggctcctcattttttcttatgcaggaccagcaattttcaataatttttttagtgacagaaaagttccataactttgaaggacttggactatgtaacagaggctcagtcccagctccaaagtatcattcagaccttaggcaatatctttggccctataaaagtttctgtaatgtcaattcaaaggccttaaggccatttttaaaagccatatttcacaaacataaaataacgcttttcttaagtactcagtttgatgaatttaaacaaacgtttacatccacaaaatcctgaatcaagatagagaacatttctatcacccccccaagttattttatctcccttcctatcaatactacccttgcccctgatcccaccagaagtaatcaagttctgatttgtcacaatttattacctttttttttttttttgagatggagtttcgctcttgttgcccaggctggagtgcaatggttcaatctcagctcaccacaatctccacctcctggattcaagctattctcctgcctcagcttcccaagtagctgggattacaggcatgcgccaccaagcccggctaaatttttgtatttttagtagagacagggtttctccatgttggtcaggctggtcttgaactcctgacctcaggtgatccacccaccttggcctcccaaagtgctgggattacaggcgtgagccactgggcccagccatgttgtctgttcttaaactaaagaaataacacagcatatattctttcatatctagctttttgctgaggattttttgtgactcattcattctgagtatcagtggtttgtttcttttcattgctgagtaatgttacatggtaggagtatatcacaatttggtcatccattcttccactgatgaacattcaggaactattatgaataaaagcactttagaatattcttttttatatgtttgtaacagttttattgaaatacaattcacctactaaacaattccttgatttaaagtatacaattaaatgcttttagtataattcatgaagctacataaacattaccacaatcaattttagaacattttgatcatacaaaaagatactcacactctctatcatcctccccatctcttagctctatacctgaccctctagccctaggcaaacactaatctaagttctgtctctacagatttgcttattctggacaattcacataaatggaatgatacaatattccattttgtaatatagagtattgtatgattccatattacaaatatggaaactgtacttctttgatataatgagaaccaggcatggtggctcgcacctgtaatcccagacactcggggggaggctgagcagcgaggatcacttaaggccaggagttcaagaccagcctgggtaatacagcaagacccacctccaaaaacaaatttaaaaaaagaaaaggccaggcatggtggcatgtgcctgtagttccagtgtcttgagatgctgaagcaggaagataacatgagcccaggagtttgaggctacagtgaactgtgatagcaccactgcattccaacacatgcaacacagcgaaacccggctcttaaaaaaaaaaaaaaaaaaaaatatatatatatatatatataaaatacgcccagcgtggtggctcacgcctgtaatcccagaactttgggaggccgaggcaggtgggtcacctgaggtcaggagttgaagaccagtctggccaacatagtgaaacctcgcctctactaaaaatacaaaaatataaaaatagccaggcatggtgacgagtgcctgtagtcccagctactagcgaggctgaggcaagagaatcgcttgaacctgggaggtgaaggttgcagtgagccaagattgcaccactgcactccagcctgggcgacagagcgagactccgtctcaaaaaatatatatatctatatatatctatctatatatctctcttatatacacgtagcatatgtgtgtagcatatgcattagcatatatacacatatgtagcatatatagcatatattcatatatgtagcatgtatgctatatatgtatatatgtatgctatatatatatgctatatatgctatatatatatacacacacacacacacacacacaaatatatatatatatatatatatatcttaatgctttcaaggttcattcatattgtggcatgtaccagtatttcatttcttttatggccaaataacatgccatgtatggatataccaccttttgttcatccattcatcagttgatggaacatttgggttgtctctacttgttggctattagaaagatgttgtaaagaatatctgtctacacattttgttttgtttgttcttctaagtacatacctaggagcagaattggtgggtcaaatacaattctatatttaactttctgaggaactgccaaaacgtattacggagtggctacatcagtagtatacaagacttctaattttccatatcctcactaaaatatgtattaggcactgtctttactgatattcagccttttgtcttgtataaatacttctcaggttactgggagcctttgattaaattccagggttctgacaaagttgttttgacaatttttgccaattttctcattgctattatgaaaaaaaatttagaggtccttaccccaccatttcactgatgtctatccaaaacccttattcttaattgccctactatactgcccaatacagaagtaatttataaaaaaagtccttttttttttaacaaaagtttatttaaatctattaagtactaggaagaattgtgtacagagtacagcatagagattctagacttatggtgatacccaaatcaattttagtatctggtcatttttgaaaatagatggtcactagaacgcttctcccacttacataaacaaacagaagtacatcagagttacatagtctattgagtgggatgaagaagagaaacaggttctgtggaaaaccttgaagctctctcatctgcagacactatataaagggtttcagcttctctctttgtagatgaagaaactgaaaaatactttggaccctcttgttcacgtctcatcctgatggcacagctgaattacccatctttgcctagcctttttagactagtttaaattcctatttggctatacttttattaataactccaaaagaatcaaataaagcatcattgtactcagttctacatactgtataattcccagtcaggttatttctgtataattcccagtcagggtgtttcttgacaattaactaagagtccactgaagtttttaattaagatatcatcaaaggaaataaaaacatactgtaattctgcagatttcatcttctttcttctttagaaagtattatctttgccctcttattctcatatccaacatctagaattggtcacctcaccttttctgcctttcatattttctacttcgtcttaatctgtaattcctatttcatcttaatatgactgcataatatttacggtcattataaaaattctggatctaccatttaaaccatttttacaatctgttagtttttacagtgatacaatgttccaactttataatatgtttttatcctaaacctaccaaaagagagtaggtaggaagcggtgtggagaaaataaaacgttagggtgaatgctggcattgacactgatatattgtaatataaacaattactttcggaaacaaatctgctcaggcttcaaaatgcaaacaaactagagtttttcttttcctttataaaaagtaaaaattttaaagttttttccaaggagaaattttgggtggctggaatgttgtgtttcttaacctaggtggtagttccagggttgtgtttactttgtggtactccactgaactatacatttttgctttgtgtacttttgtatatgcatgttatgttgaatacaaattttcaaaaagagattattatatggaagctctgtactagccagaagggaaaacaagattagaaaataaggaatctagactttatcaaggtagagaaaatacaggttgtttatcattaataacattgcatgtcattgccgatattgataataacagatatgtaacaactagctttcacaaataatagattttaaatgccaaaggaatatacagataatgtgaataaagtaaataggctttgacagtaaatacaagaaaagtttcttctcttactcaattatgtcttagcaggatgctaatcaattttgagtggttttcttgattagaagtttgtcataataaacaagaaagcatcttaaagaaaaaaaattttccttaaagctttttacaaagataacctcttagaaatcactttgtaaaaggcaaagcaggtttgagatagtccttttatttctctaataaactataattctccctatacatctacaaagaccagttcaaatactttacaatctaaaaaatggaaactaggttcaattattttacatgtatttttagaaatacactctctcaaatatatctatttgtctcaaacatttaaaagctaaacttaaaagttttactactagtgcacatcccaaaaagccacgtaaatcactttgggagtcctgaaagcacaggtgagccctataacatttctactgaaaggcataaatctcaactgcatatgtatcacaaaatcttctctatgcagcaatggccctatctaagactagagctacagcaaacaatagtttggtttccagtaggccaaaagtgcttatgaagttgccctcccacagaaaatgagatgagagattttatgattgaagggggaggcatacagaaaaagtatcctgctttatctatttctaaatttcaaagtttttaaaaatccatgaactaagagtaaaggaaaagaaaatgaacacttcatgaacagatgctctgactttatcctcattattttaaaggcagtataactcttttacagaaaagaaaaactgttcatagtcacaaatcagttaagagatgacactagattgactacagaagcaggatttttgtccttgagaatctcatagcaagaattctactcctttttgtggagaagtagaaaggtaaaaaaaaaaaaaaagatgaagtatggtagaatactaataactactacttaccagtttttctgtgaatgtttcttttcccagcttccctgaaagcaaccatggctctgaaaaaagctcggagaattgcccatcggaaaacagctacaggatcaattccaatcatcccagagataaatgcattcttgctgcttctcagaagagctacaatgtctgggcgcatatgatctgtatttttttcccggaaatcctatatgaaaaaagtaccagtgttacttatgggaaaaaaaaattatgaaaaacaagatgacgggtgataacatactttggatgcttgtccctccaaacctcatattgaaatgtgattcccccatggtggagatggggcctggtaggaggtgtttgggtcatggaggcagatccctcatgaatggattggggctctcttcaaagtaatgaatgagtttttgttctgaattcaccaaaatctggttatttaaaagtgtggcactcctacttctccatctcgttccctctctcttgccatgtgacacatgtgcttccactttgccttccaccacaagtaaaagctctctgaggcttcaccagaagccaggtagatatcagtgctctgcttcctgtacagcctgaagaatcgtgagccaattaaatctcttttctttataagttgcccagccataggtgtttctttatagaaacataagaatggactaacccaagtgacatgtttgaacagtggttgaacaatgagatagaagaaatgtctgctccaggtagctaactggaccgggtatcttctataaggtctcatccaatcctaaaactattgatttctataatacatgtaagttagaataaatattctataattttatagcagcttgttaaactctggtcagggacagcctctccaaagaggtatcacatacagcaacaggagagctgaataacaaaaagaagccagagatgagaaaactgggaagagcaagcaagggtaacacctataacctatagatgatgataagctggacaagttaggagaaaaaggataaaaaccacaggctggagcactggggacaaggagaaagtgtggaagattagataaataaataggctatttagactctgaacttcagttgtttgttcagattttattcaagtataaaggaaagccctggaaaggtaacaacatgagctaactggtgtcttatacattggttgctgcataggaaatgaattattcaaagaaagaatggaaaaaaggaggcacaatattagagtaaaccaggtaagaactgctagtaacttggacttggtcagttgtaacagcagaaataaaaaatagctatatttgggacatgtaaaggcaaaaaacctgctgattaattagggtatgatgagaaaatgaggaaatcaggttaaaacttacattttggggttgggtatttagtggatggagatgccatatactgataaggagaagactagagaaaggaaagttatgaggataagaaatgaagaccaagagatcagttttttccaagtgaagtttgggccagtgaggataataatagtaggtaacacttgagaggttagtatgtgtctggcactcttctaagtattttacatgtattgtctcatgtaatctcatttaatactcctaataatcctttcagatagatattactactctcattttatagatgagaaaactgaatcagagagaggtgaaatatcttggctcctatcacacaataagtggaagagcaagggctcaaaaacattcactcataaccaaatggatgtgtgagtctggagtgctagggagatttcagaaattatatttggttattatcaccatatagatttttttttttaaacaaggtctcgctcttcaatacagtgcagttggcaccatcatagctcactgcagcttgttaactcctggactcaggcaatcccctgcctcagccttccgtgtacctgtgagtacagatgtgcatcaccacgtctggctaattttttttcattatttttgtagagacagagtcttgccatgttgcccaggctggtcttgaactcctggcctcaagtaattcccccacctcagcctcccaaaatgctggaattacaggtgtaagccattgtgcccagccagcacacagatttttaaaactgaataagaaggattgtaaataggcagggacaaccatctaccaaagaacagaggttggaggagctagaacataagaaaatgggttaaaatgcaccataaataaatggggagagtaagcttccactctgggaacaagggcccagcctgatattacagcataggcattgactataatcttaccaaatggaaggattaaaaatttggtaagtaaatcgctccaagttggtacagcttcatagaatatctctaactcagaattctatgagaaacatacctagtatcatgtcatctatcctcatgtacagaagtcagcttgcacttatcctattacttttagggttttcctttcctaattcttctttattctcctgagaacaaggaaaaacaggaaacaagccaggaattttggtccttggcttgtccttacatacccttagagcaaacgtatgtattataaaagaaaattagaaaaactgaataagagtactcaaatccaaataacctctgacaccataatcagcagctaataactactgatggcagacaagctgtgaggcatgaacttaatgtattttacgtaacttatttttacccagttctaacaactactcaataaagcagatttagtcataagccataatttactgataagtaaacagaaaggtaaagcagcttgccaaaggtcaaagagacaataagtaccagtgcagaaactgaaacaccagtctgccctactcctattaataactacactgtacaacctaaaaacctaggattcttttcaatgctgactgtcaagtgttgagagtgaccagtgaccttcattttcaaaatgaaataatctgtcttcatatttctagatttctaagtacattatcaactgaccatatcattcttcttcaaaatctctctctagtttccacaagaacatactttgtggtttaccatttacctcctatactgcccttctaagtcctcattgctagttcatattggaaattcaagggtgggtttaacagtgtgtactcatttctctttttttggtttgtttgttttttgagacagggtcttgttctgttgcccaggctggagtgcagtggcaccatctcaattcactgcaacctctgcctcccgggctcaagtgaattctacccctctgcctcccaagtagctgggactacaggcacacaccaccatgcccagctaaccattggtattctgtgtagacactaggccttcccatgttccccaggctgatctcgaactccaggacttaagtgatccacccacctcggcctcccaaagtgctgggattacaggagtgagccaccacacctggctgtgcactcatttcttcactcaaccctcttatatcaagtgatcagaaccagagttacgactttattttattttatgtatttagagacagagtttcgctcttgttgctcaggctggagtgcaatggcttgatcttggctcaccgcaacctccacctcctgggttcaagcaattgtcctgcctcagcctcctgagtagctgggattacaggcatacacgccaccacgcctggctaattttctatttttttagtagagacagggtttcttcatgttgatcaagctggtctcgaactcctgacctcaggtgatctgcctgccttggcctcccaaagtgctgggattacaggcgtgaagttatgactttaaattaacaccatcgcccaaatgcaaatttccagatcagatctttcttattatttcttgagatccattaacaaatcttaaaggatatgtctaatttgaaagaaaatgtgtaagaccagtagtacatttaaatgtttggaagcattcactagtaaaaccatgtgggcctgggatttcctctgtggaaaagttctgaactactgattcaaattatttagccaacagaattttcaggtttttctatttattctggtgttagttttggtaaagtgttttttaatggaatttatccattttttgttttcaaatttcctgacaaaatatatgcatatccttctaatatctgtaggttatgtagtaaagttcttttttcattcctggtatctgtaatctataattttttttatattatcagttattttcctattgcatttaatttatattattttgtgttatcttctcaaggaactaacttttggcttagttgatttctttgttcaatgtctgctttatattgcactgatttctggtcttatttttataccctttctctaattcctttgagtgtgatttctcttttcctagtttctcacatagaagcttagagaaccacttttcaatcaagcatggtggctcacacctgtaatcccagcactctgggagactgaggtgagcagatcacttggggccaggagtttgagaccagcctagccaacatggcgaaaccccatctctaccaaaaatacaaaaactggctgggcgcgatggctcacatctgtaatcccagcactttgggaggtcaaggctggcggatcacgaggtgaagaaattgagaccatcctggccaacatggtgacaccccatctctactaaaaaaaaaaaaaaaaaaaattagctgggcgtggtggcatgtgcctgtagtcccagctactcaggaggctgaggcaggagaatcacttgaacccgggaggcagaggttgcagtgagccgagatcgcgccactgcattccagccgggtgacagagtgagactccatctcaaaaaacaaaaacaaaaaaattagccaggcatggtggcacaagcctgtagtcctagctacttgggaggctgaggaacgagaattgcttgaacccaggtggtggtggttgcagtacgccaagatcgcaccactgcactccagcctgggtgataaaacaagactcttgtctcaaaaaaaaaaaaagtttagataaccacttttcaacttttcttcctttccaacatatgtatttaaagttataaactttcctacattccttgctttaactgtatcctacaagtttctgataggctggatttcattaatgttcagtataaaatattataattttaataatttattataagtaatttatattgtcatttcttttttgactcatgggttattcagaagagttttgcttagtttctaaatatccaatgattttctaagttatccttatgatgtgctaattaggtcacctatttaacagtgctatttgtattgattttgtgttgcttgttctgttagttactaacagaaatgtgttaaaatctataattttttcttttttaagtttttttctttttccttagaaaaatattgaagaaaaaaatctacaattatgatggtgcacttatctaggtctacttttgctttccttttgctttatatattttaaatcagtcattagctacatataatatcaagtggctcatgcctgtaatcctagcactttgggaggccgaggagggtggatcaactgaggtcagatgttcgagaccagcctggccaacatagtgaaaccccatctctagtaaaaatacaaaaattcgctgggcgtggtggagtacgcctctgatcccagctactcaggaggcagagaatcgcttaaacctggagggcggaggttgcagtgagtcgagatcacaccacttcacttcagcctggcaaaagagcgaagcgagactccgtctcaaaacaaacaaacaaacaaaaaccccaaaaacatttagtgattacgtcttcctgttgaactggccccttttatcattataaaatgtccctttgtatctctagtaatatttctggtcttaaagtctattttgtcctacaattttttttttttggagacagagtctcactctctttctcaggctggagtgaaatggcactatctcggctcaatgcaacctcctcctcccaggttcaagcacttgtcctatctcaccctcctcagtagctgggattacaggcgtgcaccaccatgcctggctaatttttgtatttttagtagagatgaggtttcaccacgttgaccaggctagtctcagacttatgacctcagatgatccacccatctcagcctcccaaagtgctgggattacaggcgtgagccaccatgcccagcctgtccagaaataatatacaccagcttttatcctttctccatctttttactttcaacctatctgataacgcagatgaatatcccaggcaagtgtgtgtgtgtgtgtgtgtgtgtgtgtgtgtgtgtgtgtgtatgattctatttatctgaaatttaattaaaagtaaaattaagaatgataaaaattagggcagtggtaatctctgaggggagctggctgggaaggggtataaaagaaatctaaacactttatttgtgcactttatgcacaatatcctcaagtttttctatagctcaagcttttgttttactttttaaactatagtcttaatttctattctaaaatccattccttccagtattttccatcttaggaaatggtacctccaaagcacccatcagctctagccagaggtcacttactcatttagagtccatcaataaagtctgtggatggtttaccgccagaaatacatctcataatcatctggatcccccccaacctctactgccactccagtgcttcagtttaccttaagatttcacttcaatttaaaaaaaagtgacttaactgatcttccagattccactcttaccctctgctatcccttctcctcaaggtaatcaatgcaatcttttaaaaacacaagtcgtatcctctgcttaaaatattatcacagtgccactaatttggataaaagccaaactcaacttggcttacaagccctaaataataaccccctgtctattctctaagttcatttcatgttactctccttagttcattataatctagtagcacttacctgttttcaattatttcaccatatcaaactcctatctcctggcctataatattcatcatccgaactcctcatcaaggtaacatttatttcaggtcatctctcaaaatttaagtttcttagagaagtgttcatgtattcacaaattcaaaatccactattttactactttctctcataggacccattaacttatttataacacatagcccatttatctatgttatacaaatagatacacacacatatatatatgcacacacaatatgtatatatgcacatatgtatagagaatcaggactacatctgtctagtttatcattagatcattccaaacaccaagcacaaagtctgacacatgttctgtgttcaacaaatacttcttaaataaatcaataaatggatgaataaatgatcttaagacactcgactcaagacccaggagaaaacatttaattccactattctccatatcatcagctgccttacctgggaaattaaatgcctgaaatagcaggcttaaacatcaagtagttaaagaataacagactcacaaattacacaagaaatggacaacattattaagattccactccacataagagtttcaatatattcatgaaaagtacgaactgacaaatccctaatggtgaacagagacatgaagaccttatgagtgcagagaagggaaaaattcaacaaattatgtgcataaacaagtgagtttgggatatacagatgcaatctattctttcagatctaaagtttatcaggatcaactgacaacatcaggtttatctccaggcagaaaccaacagaaacattaccttacctaagacagtaatgtgctgaaaagcagaatctaagttttagtagtatctttatacaatatctccagttattactgatcaaaagcctccacaaactacaaagagggcagtgtgctggggacagttaagaacacatctctgccctgtaagcatattcagtgagaaatttactgacctttaccccatattttacttttccagcataatgttttataatgaaagcaggctccatcacggctggaaattcgatgtaagaattatcttcatgttgatgcttaaacttgtctagcaatgtttgatttgtagcctgtggaaagctgaattaaaaaaaaaagaaaaaatatcattacagaaagatgagaaagatgcggtaattagtacagcccttttcaaagtacattacaattacattgccatcttacatagcagtttacaaaagttttcacctatattatctaacctgattctcataacaagctaaaaagtaataataaatattggtgttactattttatagatgagggatcaaaagttatgatttgcctgtactcatattttgcaagtagtagtaccaagaaattaactcattacatatttagcttagattgcagtgttctgaactactataaaacccaaaggaaaataaaatccaaatcatatactctttggggccaacaacttccaaataagagaataatatctcgattctcataggtactaaaaatccataagaattatttgacttcctgttcctacatgcataaataagtagccattttcttactataccaattatttgtactcattgattgtactgatcaactgagcacttaatatccaggaatcacacaaataatatctattatttaatcgcataataggaaatatggaaatacaaaagttcaaaagaggaaaaaaatcatcactggtgtaaataatgaaaaagttcacacaggacatagtaggtgttaagactgtgatgttaaaggttgggaagggtttcaaagagagaaaatatcattgacagaaaaaggagaaagaaagtttcagaaaatagcttcatttaatggtagctgaaataatgaaaaataatgtgacatgaggttgtaaagttgcttaatacaaatctaatgtgtaaaaatcattccaaaattacaacaaacatagttaattacatagtatgcattgcaaaccatacagagaatggcctttagcatcagataatcatagtttacattacgcattctatcagtgacctggggcaaactaggtaaccttctttgagaaggggtcttctaacccacaaaatgagataccagttatcacagtgccagtagaattaaataaaactagtaaaaacatctggcaaccgcaggcatcctctagggattaaacaaacatcgacttcatgttgccaacactgatattttcttggtcaccttgacctgcttttgtattcaaatatctcttcctcaaaacatctctaccatctagctcactccaaaactttaaagccattttacaatggaatataacttactatttcaaacagagacaacagcacagctcctataacagtctcaccaatcttctttcaagtcaccaaagcatattatcaaaataaattttcctataatagtgctttaatcatgtgccccctctgctccgaaatgtatagatcaccaaggcaaaaagacttgattccaagctccaaagcataggccagctcaacctctgcaaacttatatctcactacttcacagcagtgtgcctctcttaaggcaggatgctcacttcgtcgtctctaggtcagggtttatttgccttctaatcatctgagtaattgaaaagcttatgatatactttctcttacttttaaatggataatagaaattttcaaaggaaggaagatagacatgaaaacagtcattacttgaaactaaaaaagatggaaagttcctgcattcaacagacatgtatggatacttattacattaccaggcaaaaaaaaaaatttggaacacaagaaaatcattcattattgctcatatcaaagctcttcatctagtgttcctcaaacactatctggaagggtagcgtcaggagaacctctagagatttgaaaactaccaatgcctggatcccaactattgcaattctgacttaaatgattagggagatgacctagcatcagtggtatttacaaagtcccaaggtaattctcatgagcaggcaagattcacaaaatgctgccttaaatgaatgctctaatcctaacttcggttgttaaaatgtagattctgattcaacagatctggaatgaaagcttgagattctacatttctaacaagaatcaaagtggtccactgctgctgatagaagatgacactttgaatactatgggaagattgatactattcctaacatcctattcatatgtaactctgatacaatattcctccttcctaaatgccaccctacatcctacagaatctagctaaagtaacctgccccataacatacagccattaagtaggaaaggctaaaccaagacctctgattctaaacccatacacctagagcactacaaacacactgcatgaagaacacaactaaggatatatttgacattatatattccctataaaaaatatttttagagaaaaaatactcaatgtaagtcccaaaatagttcttcctacatgtgactaatttattttcaatctagtttttttacaggtaaatgggagagaaaaaaatatttcatgcctttgcatcttctggaatgttaaagcacagaaattctttacaaggacaggtaataactacaggactgactcataaaaaggttattcagtccagtatcctacctacaacaatacgctgacagatgatgcaaagtaattataataataggaaattacattaattgttaaagcagctgccaatcagctctaataattataaagttcttcattttattgagccagaatttatctccctgatatttatggccacatggctcaaccctcgtagctttcgggtaacagcaaataagtgacattctcggccgggcgcagtggctcacacctgtaatcccagcaatttgggaggctgaggcgggtggatcacaaggtcaggaggtcgagaccatcctggctaacacagtgaaaccccatctctactgaaaaaacacaaaaaaattagccgggcatgggggcgggcgcctgtagtcccagctgctcgggaggctgaggcagcagaatggcattaacccgggaagcagagcttgcagtgagctgagatcgtgccgctgcactccagcctgggcgacagagcgagactccgtatcagaaaaaattaaaaaaaaaaaaagaagtgacattctcattattgggttaaatctatgtgaagtagcaactggtcaggaaattatagtctttgtataataagatgtgcattcaatgaaattttgtttaaagaatgacaggacaggacaggcacagtgattctcatatgtaatcccagcactttgggaggctaaggtaggaggacagcttgagcccaggagtttgagaccagcctgggcaacaaagttgactccttgtctctaaaacaacattttaaaattagccagacgtggtggtatgtgcctgtagtcccagctactcaggaggctgaggcgagatcactcgagcccataaattcaaggcttcagtaagccataaccgcaccacggcattccagcctgagctacagagctagacactgtctcaaaaaaaaagaaaaaaaaagaaaaaaaaaaaacaaagtaattctactacctcagttgctgtttacaaacaccttaagatatataggacggaacatcatcatgtaccattgtcatttgccttctgcatacaagaaaactgaggactaaggatattatgagatctgccaagggtagttttgatatatacagttgtgatattataaataaataaatatatatatttatttttatatatataggttttcatccacggttcctggctcataactcctgcagcccttggtgtagtcttttgttataatgttggggtgctttaggcctcaggagcaggcctcaggaaacagaatctctctctctaaccttcttctgtcctccttttacctgcccaagggaggcctctaatatgattgccggttaaaagaccctcattccagaaagggtccctccccatattctgaaagaaaaaatgctgcacaagaagccaggaagaatctggacagacaggccttgctgggtttcccactcatgagatcatgttcttttgtccaatcacatttctacacagggtcaatagtgcctatgtaatgaagcctccataaaaacccaaaaggacagcacttagagagcttccagatagccgaacatatgggtgctcctggaaggtagagtgcccaggaaggacatggagactctctactccttcccccataccttgccctacacatctcttcattgtatcctttgcaatatcctttataatatactggggtaaatgtaagtaagtgtttccccaagttctgcaagccactccagcaaattaattgaactcaaggagaagctggttggtcagaagttctggaagagtagattattgactggtgtttgaaggtggggtggggtgcagttttggggactgagtcctcgatctgtgggatctgatgctacttccaggtagatagtatcaaatttgaattagaggacacccagttggtgtccactgcttgctggtggggaaaaccccacaaacgtttggtcacagatgtcttcatgttgattgttatggtgtgagagcagaggaaaacatggttttaatgtttttcccaaataactggtgtcagagaagtgagatttgctaaaaaggccctggctcactgaaacatgtggtttgggaagaaaaaggataaaagggtagaagatgagaaacctttgttctggtgtggccacatggtcacccaaggtatgaagccatagctgctatgctcggttattaaaggtaaaagttatcagtggaatttagagatggttccaactcctggggaattggttcactggctgcataaggaaatgcaaactaataagaaaaaaaatgaactggctgttataaataaatagccataaaactagctattataaataaataatcccttaattattgttatttataatagctaaaatgaaatttaaagagagtactgtgttggtccttgaagctggataaacctcagatcttggtctgtttgagctcaggctgctggcctcaaagccaccctccaaggacagaattgtgcaggggcaacaaagtacctctgagacatgtggttaccaagaaggtagtcaatgtggaaaaagggcaaaacgaagtaactgcaccccaccccaccttcagacaccagccaataattcatgcctccagaacttctgaccaaccagcttctccttgagttcaattaatttgcatagtgtgaaggaatagttccattttgtagattggtatcattagcttcctaaagaacctttactaaaatggattatgagagtaactacattaggggcagtagctttggtttaaatgctaccgtggaaaacatgtttgggttgatgtaggacacagggctcactactaagcaatctcagacatctatacatgattgagacacacaggacgttattcccaaggcaacagccagcatagtggactggataaaagccactgtatgatctttttactctggaaagggggattgcccaactttccctagaaatgccaagcagaacaacccagatgaagcagctgatatgcttcatatgcaagctacgtaagactagctttatgatgataaggatattcgcccaatgaatgtgtctgttatctacttacgaggttacagtaaatgctgtagttaagggggtcccttctacataggtccatgaaatgagcagatatgggggtactacagcagtgctgagaagcgctaaatctagacattcctcttacaccttctctcaagcacaaaatgccaataagaactgttctttttgtcagcaagagagtctgagacttccaatggctatgtggcagtttccttagtgggaagaccctgaatgtagaaggtaagtgagactgatgctggtagccctggggggctacaaatgaatgggtcttgacaggaatagtcaccgactctgaagtgagctttccttacccagtggaagatgcaaatgctcagagtgccatttaaaaaacaaacaaacaaacaaaaaccaaaaaacagaaaatatcgcatggatttggacaatcatcatcttttcagaacgagaaacacattgtacagcctaccatgtccaacaaagaggaaaaaaaaatcctcctcagagtaacagtttgatgaaggagtaggatgggcaattaaaacactggttgtctaaaacacaggaagataaaagaatgaagggctggcttgcatgctttcacgagtgtgtgctcacattcaacatgagtgggactaaaggagcatccccttagatttttcttgtttttctggttcatctgggaaagaggcggttggggaaggtgctggtatgactatccaattcttcccaagggaggagtacactggtataacaactataatttttttcttccccagatgacctcaaaaagaaaaaactttttttctctccgctaccagatgcagtggtcctaggacaagggctgcaactgcaagtgctggaagcagggatgatttctaagcaagaaactgtaactacatttttaaaccttaagtcaaaattcctaagggcataatgggggtgggttgtaccttcactctatctagcaaaattggggctaagagtgaatgcaactactacttttcctggccataaaaacagctcactagttctgcacccatgtaatttaccctatctaaaggggagtggactgaggaggaggtacttgctagactagagttgttgtctgcaatctaaaccagcacagtggcaattcttaatgtgccttccaaaggaggaaaagtttgggaactactggagaggaggaatagcagctgagggtaaagacaggaataaatgggttattcattgagggaaatccaacattacattaacacatttaaagaagctcagagcaagagatgacactgtctttaactcagttataagagatgctcaaaaggtaaaagttgtatgtttgcggagactgctcctgcttctggaatctgacaagactgaaaggaagcctgcaaacttgagtggtctctccctgggagacatattcatacaacatgataatgaactggactaattactaatgactgaatgggattctagtaatgtagcagtatgtttgagttgtatattcttttgatgatgtaaaggatccatgtttgaaagccagggcgtggcctatgacatgattttatcgtgtgtgtgtgtgtgtgtgtaggttttcgtccatggttcctgacttattaactaccacagccctttggcctatgacgtgattttatcgtgtgtgtgtgtgtgtgtgtgtgtgtgtgtgtgtgtgtaggttttcgtccatggttcctgacttattaactaccacagcccttggtgtagtcttttgttataatgttggggtgctttaggtctcaggagcaggtcacaggagtgctttaggtctcaggagcaggtcacaggagcaagcctcaggaaacagaatctttctctctaacctcctgtcttccttttacctgcccaaggcaggtctctaatctgattgtgaatcaaaagatcctcattccagaaagggtcctgccccatactctgaaggaaagaatgctgcacagagaggccaagaagaatctagacaaacaggccttactgggtttctcactcagtctattagtatgagatcatactctttttgtccaatcacatttctacacagttgtcagtaatgcctatgtaatgaagcctccataaaaaccccaaaaaagagcattcagagagattctgaatagctgaacatgtgggagttcctggagggtggtacacccagggaggacatggaggctctgtgctccttcccccacacctcgtcctacgcagctcctcattgtttcgttttccctgagttctgcaagctgctcgggcaaattaattgaactcaaggagaacctggttggtcagaagttctggaggcatggattacaggcgggggtctgaaggtggggtgaggtgcagttttggggactgagccctcgatctgtgggatctgatactacctccaggtagacagtgtcaaatctgaatagaggatacccagctggtgtccactgcttattagtggggaaaaaaccccacacatttggtcacagaagtcttctgtgttgattactgtggtgttagagtaaaggaaaaacacagtttgagagtttttctgtaacagtagttatagaaatgggatacaagtcctggacttctgactctaacacctaaatattacagggaagcaatataatacttcaaagcacaagcttattagtcagaaatacttgacaggtttgactctcaggtcctccatttcctacctatataatcttttttcttggattgtttcttaaactttcttttgttactataaaattccccaaacaaaaagaaatgctaatcattccattatcaaccacaacggttctcaacacggaatatcaaaatcacctataaagccttcccaaataaacatataccagaggtagggtatacaaacagtgaattacaaaccttacaattttatgagagacaataattatgttggggcatatagagtaatgcaagaaacttttacaaaactctggacagaaaattaaggtactttttacttgtgttaacagcattttaatttctttagattaatggaagttgactagtgatagagtaggtcagagtgacactaaactgttagcagtcttctttctgttagctttttattctaccaccttacacaatcatcttacctctaatagtaaatcctcaatactttctatcttgtctaatgaatattaaactagaaatcaggtaaataaattcaatttctaaattttttactaaacagtcataaaaacctcacaaccacctcatctcagtttctccaaatctagatttgccatctcttaggataatcaactgtattttatacattgttgagaatactctgaagaatgctacataaagcattatttctgaagcatatatttaactcagttatattgaacagtgttatcaaggaatagtaaataactggcagatgttgccacttacactgcacgatcatggcagacattactaatttaccataacattcttttttctgttttgtttttttggagacaaagtcttgctctgtcgcccaggctggactatagtgcattggcgccatctcggctcactgcaacctctgcctcctgggttcaagcggttctcatgcctcagcctcctaagtagctgggattacaggcctgcactactatgcccagctaattttcatattttcagcacagacaagatttcaccatgttggccaggctggtctcgaactcctggcctcaagtgctcctcccgccttggcatcccaaagtgttgagattacagacataagccaccacgtttggcctatcacgatattcttttctgctaaacatgaaaactacaaacacatctcatacatgaagctcaatttacaaagaaagaaacatgtaaccaaaaaaaaaagtcaacaagtttgacatcaaggtgtattgaataaatctagaagaacttaagaaaaaaatgaattcaagtaatgaagcccatcctaattacctagaaacacacagatataaaaaaaaattgtggccacacgcggtggctcacgcctgtaatcccagcactttgggaggccaaggcaggtggatcatgaggtcaggcgatcgagaccatcctggctaacacggtgaaaccccgtctgtactaaaaatacaaaaaattagccaggcatggtggcgggcacctgtagtcccagctactttggaggctaaggcaggagaatggcgtgaacccaggaggtggaggttgcaatgagccgagatggggccaatgcactccagcctgggtgacagatcaagactccgtctcaaaaataaataaaaaaataaattgtacaaaaaaaatttggctctttatttggtaatgtaagaaaaaagtttaaacttaaaaggagataaaaagccaaaacagccaataacaaaattgaaaagaatcacactcacttgctttcttcatccaaaagatgaagcagtcctgttggttttttgctaataagatttatgcagcaggtattatcaatgtaatctatgttgtgccagctgataccttcagttctatattcctcctagaaaaaccaaaaaataaaataacaatttattcatcttgcagaaaataggtatataatatagattgaaaagcttttaccctgcttaaaattctaagattttaaaaatcaccaatccacacaatgaaagaatgtataatttcagttgtacaaatcttaatacaacgtatttgttttctcttaaaaagacatgccacaaattttttttgttagaatgccagttctaagttcattctaatcaaaatgtagggctagatttgttttagtctcactacctgatgactccactaagtaaaaacgtacaatgaagaaaaaaggctaatatctcccacatgactttaagccatcaaaaagcactatatttcctggattatcaacaatgaatttaatgaaacaatttctgggaaaagtgggaccccatcaccctccagtaattatatggaattcatacacactaaactttggcaaaatataatctttaggactttttttttttttaaagaaaaggttttgaattctaaggttaaaaaactcgaggttcaggtcttgagtaactacttaaaatcatcttacaaagcgctccattttttcttattctttcctgtatggagatatattcttctattcatccttgtgatactttcactttttagatggtttttttaaggaaaaaatgcacctgagaatgtaaaggagatatgtttctgcactgcagtggtatttaggcatcaggtaaaatatcccatgtacctaattgttttagcattcacttacagtacttgcagcacaagtcaactgccaatctgcaaatagtgattttgaaattcttttttgttgttctttttgattttgaaattccatcattctttctgtattcattattatccagtaaagaagaatgaacactaacataaactatagttactctaactaggaaaggtaaatacttaattcttttcttttaattaacaatttcacacataagaaatagtcatataaaggtcactccccaatggcagtaagaaaggtatttccccccaattttttgcagcatgaaaaatatacacactagatagtatgagcttaatgatttttataggcattactagaagtccaaaagtcctcctcattatctcttcccaaggactatccaaaccctcctacccaaagtcagcttctaatacaatcaataagattcccctatttataaatagtatctaaatggaatcacataacacatactcattttgtctcttttcttttttcattcagctaatgtttcagagacacaaccattttgttggatgtacctgaagttcattcattttaattgcattgtgaaacaacacaatcactcagctacatattgtctatggctactttgtcaatgtaacagctgagttgagacatatggcccaaaaagccttaaaagatctggcccttatagaaaaagtgtgccaaactctgctacaaagcattagttctaaaactttaacatacaacggaatcacaagaacggcttgttaaaaaacaagagtattgggactccatccccagaatttctgcttaagtaggtatagagtacttagaattttcatttctaaaaaggttccaggtgatgctgatgctattattgaggagagagaaggaataaactttgagaatcactgctgtagagtattccattgtatctgtatacaataacttgttcacccattctacttttttctttttttttaagagacaggatctctctttgttgcccaggctggtctcgaactcctggcctcaagcaatctcaagcaatcctcccacaacactgggattataggcacaagtcaagccccactctactactgatagacactgctcttaattctaatatttggtcattaaaaataacgtcttatgaccatttccacacaaaacttttggtgtgcatttatacttatctttgagtgaaaacacaggattataaactacatgtttaaccacagcagataatgccaaacagcattctgatgtggttgtggcaatttacatacccaccccagcgtatgtccctatagacatatctctccaatactcgtattgtctgtctttttcattttagtcatttcggtgaatgcctactagtagctcattgtgattttagctttgatttccctgatgaataacaaagaaaaaacattttcctatgtttactgctcatttggatttccccttgtatgacgtgcttgtattcatgataaaaactcttggctgggcacagtgtctcacatctgtaattccaatgctttgggaggcctagctgggaagatcacttgaggccatgagtttgagactaaccaggacaacatattgagaccctgactctacaaaaataaagaaaaaaattagctgagcatggtggtatgcacctgtagtcccagctacttgggaggctgaggcaagacgacctcttgagcccaggagatcaagtctgcagtgagctatgattgcgccactgcactccaccctgggctgcagagcgagactctgtcttaaaaacaaaaaacaaacaaacaagcaaaactctcggaaaacattattgccttgttcttagtctcagaggaaaagcactcagtctttttcattcaataagatattagctgtattttgtagatgtcctttatcagaaaatcattttctactcctagtttaaaagaaaaaaaggaatagctacacagttttatcaactgctttttatatatctcgagataactgtgttttctccttatttattaacagatgattaaatggcttgattcagttaaatgtaaagcacatgctgaaaaaaaaatctccctttggttacaatgtattatccttttgtacatattgatggattttattaatgtttgtttagaatttttgtatctgtgtttatgagtgaaactgacctataatttccacttctaatatccttaacagatgtgtgtatcattgttatcctggccccctaaaatgtactgagaattgtccttttttctattccacctaacagcttatgtcagactgacactctttcttctttccatgttggtataatttacccgtggagccaccatggcttgcaatgttcttcagggaaaggttttaaattacatattcaatgtcattaatagttatagaaacagattttctatttcttctatgtcagttttgaaaagctcttttgttcgtatcatttgacaagtctattaacataaagttattcagtgtgtctatctttttaatatgtgtaggatccagagtaataccctctatcactgggattttggttatttatatccctctctctgtcttgtctctctctctctctctctctctctctctcagatgaattccttgaggggttcatcaatattattagccctttcaaagtattacttttggtttggttgatcctctcccatggtatatttgttttcacacttttattaatttcctcttttatctctattatttcattttctctactttcctctggtttagtttgctgatctttttcccaactgttgacagggatcactgattttaaacaaaaatcttctaagagctatgaaatgttcttctaagtatagctttaggcatttcccatagttttaatatgtaacgtgtcattaggtacaatatattttctaattgttcaacctctagcctatttagaattttttttttttttttttttttttttttttttgggacagagtctcactctgtcgcccaggctggagtgcagtggcccaatctcagctcactgcaagctccgcctcgcgggttcacaccattctcctgcctcaccctcctgagtagctgggactacaggggcctgccaccatgcctggctaacttttttgtatttttagtaaagacggggtttcaccgtgttagccaggatggtctcgatatcctgacctcgtgatctgcccacctcagcctcccaaagtgctgggattacaggcgtgagccaccgtgcccagcctagaatatttcttaatttttaatcatataggtatttttcagttattttttagttactgatttcaggtataattttattatggtattaaaatctgtgtcatttcaatccttggaaatctgactttcgctttatggtccaggatataaacaaattttgtaaatatcccacgcaaacttgaaaaaaaagtgcattctgcagctgttgatgcagtgttctatgcatatcagttatatatttgatttttaaatcttctatatccttaattgattaggtttcaggcctaagggcaggaaactgacattctgctctgaaggacagtcagtgatggatgcccacaaaggcactaatctcatcttctagatattttaaatcttctgtatccttaccaactttttgaacacttattctatcagcaagtcagcatggtatgttaaaacattccactatgatggtaaatatatttttcttttttgagttttattcattattgctttatatattttgaggttctgctatcaggtgcttataaattttggactgtatactacttcccaaggaagtgaataatgctaaagggtaacattattaaatattcctttttatctctagtaatgcttgaaatatgatattaatatagctacaactgctttttttcttaaggtttactaaatctttgctcatccttttaatctttctatatacttatatttaaaatgtctctcataagcaacaatcagtttagttttgtattatatctagtctgacaatctttagcttctagttagagcaatgaatcaattatatttaatgtaatcactaatatttgtgagattaaatcaaacaccttactacttgttctttgactttcatggcattccttttatttcttgctttcttctggattgagtgttcttattttacttatcctctgtattttttttcaagttttatattattttactatttttggcaattctagaaaacatgtatccttaacttatcactaacagaaataatatctctgtaacttagcatttaatacaaagatcttagagtatcttaaattctatttactcctaacttatatgctattactgtcatgtattttagttacatttaaacattaaatagttttttattttttttatttcttttttttttttttttttttttttgagatggagtctcgctctgtcacccaggatggagtgcaatagcgtgatctcagctcactggaacttccgcgaacccttcccagctacaagcaattctcctgcctcagcctcctgagtagctgggattgcaggcggctgccaccacgccctgctaatttttgtagttttagtagagtcggggtttcaccatgttggccaggctggtctcacactcctgacctcaggtgatccacctgcctcagcctcccaaagtgctgggattacaggcgtgagccaccacgcccagcctaaatagttctatttaagccataaaagttatttttaactttgcctcattaatattcatttagattcaacgacttttttataattttcattgctcttcattccttcctgtacctgagctacaataggaaacaacttgctgcctaaacaatataccttggttttaaggaaaatatgccattgtctcctagcttccactatttccactgaaaggctgactgccaagtcttattgttgtatctttaaagatagagatgtccctgacttacgatgattcaactttacaatggggtgaaactgtcataatttctgcagactttatctttgcctaggctggtgatatgtggtacatgagatattcaacatttttactataaaataggtattgtgttagatgattttgcccaactgtaggctaatgtaagtgttctgagcacatttaatgtcctgcacatttaaggtaggctatgtcaagttatgatgcttggtagtttagatgcattaaatgcatttttgacttaaaatattttcagcttggcaaggagcaactgtagtctctggtttcctctagctgctttttagacttttttcattgtctttggtttagtataattttctaggtataaatatctttgtatttaacatgccttggattcttaaagagcttttcaaatgtatgcttgttgggtttgtttttttgttttgacagttttggaacattctcaaccattatgtcttcaaacacggcttctaacttattctacgtctctcatacacatctttccaaaattcctatggcacatgttagacctttttactatgctcttagagtataagtctctttcttatcttcattcattaggctcagtattttcttctggtctatcttccaatttactaattttactaacctgtatcttactattaaaaaccatctgtgtcttttcaatttcacagtactttttagttctaggttttccccaatttgggatttttaaaagtaatttgtagttctttaataaaaatattgcaccttattttttaaaatttcttgaaagcatggttagtttccagtccatgtctagtgctaatatcattggctggatccactgtggtattattatctcatttctcttgggatattttgttgttgttgttgagacgcaatctcactctgtcactcaggctgcagtgcagtggtacaaactcagctcactgcaacctccgcctcctgggttcaagcaattctcctccctcagcctcttgtatagctgggattacaggcatgtgccaccaagcccagctaatttttgtatttttagtaaagatggggtttcaccatgttgaccaggctggtcttgaactcctgacctcaagtgatccacctgcctcagccccctaaagtgctgggattacagacgtgagccaccatgcccggccacatttctcgtggtttttattcatgctggtttgcctccatgtatgtctttatgtctctgtctgtctctctctctctctgttttggactgagtgttagatcctgtatatgaaaaattataaagataattttagcagttggatgatgtcttcttctggtggagattgtatttgctcttggcaggtggttaagaatactacaaattgtattttaacctaattgggaactgagatgattttaaactgggcttcagtccttctgatgccaggtttacttctgatttacttttgtctgagatgtaaccctttagggatctcaacctaaagcctataggaattaccaagggcctcctccttatttttgagtcagaagaaaaccctgctcaattcctcatactctcaagcctggcccttttagaatcagaaacactacaaaaataacgaaatgtctctaggaacaaagcagcacccaaatgctgggctcacttccctagatttctttcttatagtctaggccctgtaaaacttatttgaaggtactccaatgccttcaaatatatgttgttgaagttttttggttgttctccaaggtaaggttcatcaaaagtttctagtctgacaacaacaagtaaaatggatgaaacaaaaacttgctagattatgagctcctcaaataagatccctgcactctaaattttctatcttctatgcttagcacactgcctggcacacaactgttgttcaatttactgatgaatcaatcaaatgaagagtaattctcagcaagtaaggaaaagaaaaaagagggcagtaatacaagtaacagaaaacatacaattggccctccatatctgcaaaagtttccacatttgtagatccaaccgaccacatatcaaaaatatttagagaaaaaaatgcaaaaaatataaacttagaaacagtatagcaactatttacataccatttacagtgtattaagtataagaaactgagagatgatctaaagtatactggagaatgtgcataggttatgtgcaaatactatgccattttacataagggacttgagcatctgtggattttggtattcttcagcagggggtcctgaaaccaatcccctgtggatacccagggatggctgtactttcaaatatcagaaacctctttgggtctgtctcttagtctacattacagtctctaccactaccttgattcagttcagaatcactcacccattctacagtcatgtgccacacaaacacatttcagtcaagaaccaactgcatatacaacagggatccctaatctcacgaaaaattcatattatctactgacgtcttgatcctgaccctgtgtaggcctatgctaatatgctatggtaatatgtatgtatacatgctaacatgtatgtatgtgtctttgcttttaacaaaaaagtttttaaagttttaaaaaattttaatagaaagagggcttataattatataaagagaaaacatttttgtacagctgtacaatgtgtttgtgttttaaatggctactacaaaagtcaaaaagttaaaaaagtttataaagtaaaaacattacagtaggctcaggttaatttattacaaaaaaattaataaatttagtgtaacttaagtgtacagtgtttataaagtctaactagtgtgtgtacagtaatgtcctaggcctttatcaccactcacccaacatctcacccagagtaacctccagtcctgcaagctctaatcatgggaggtgccctatgtaactgtactattttttatcttttatattgtatttttactgtatcttttctatgtttagatacatttagatacacaaatacttaccattgtgttgcagttgcctacaatattcagtgtagcatgctgtacaggtttgtggcctaggagcaataggctatatcatatagcctaggtgtgtaggaggctataccaactaggtttgtgtaaatacaggatgatgttcatacaacagcaaaatcacctaatgatgcatttctcagaacatatcctcatcattaagtgacacatgacagtacttcaactagttcatagatttttctccttctttccagttcactgctcttcagttcaattcaagtcctctgctaaatatacttcaaatagcttctcattgtctgaaaaattctaatcttccctgcatgacatataagtccactgttttaagtacaatgtgtataatgttacctttgcctaaaatatcttttcccattgacaatctagtgagcttcagctcactatttgaaattatatgccagaatcaaccctggaaaatttttgcagcctttcaggtagttccaatcaaccccatcctttgtgtaactactttaccttatatctgattatagcatttacatcctgcatggcaattattacatctctctcccatcctatatgcctatgtactccttttggacaaaatttagaaccaaaccacagtcatcatattgaagatttttcctacaaatgtacctgtgatactgtaccttctttttaaaaattttaaccttaacttattttatactcaactgaacttaacaagtaatcactgagtacccatttcataccagttaccaatgaggtacatataaataagacacttaacaagattctgatccataattgcaccacattgcccaaaatgctgacattcagggtagcaagtaaatgagaatcacccatcttccaagtagttttgaacacattttccataaactctaaggttttttatttttatatataatacgtttatggccaaggcatttcttctggctgtctaatctagacttctagaaaagaataatttcagtttacaataaagaatgtttgtctttttcaaaatcaatttaaccaatgttctgtttaatgatccacagagcaactgatgttctgctctgtaaaatatagaacccagaaaactaaatgcattccctcacccttctaacacatgtacttatttgcaagagataaagaatattaacttagtatgatttatgtaagagttttggactgattcaatagacatggatggcaatcccagcttagcttttgattaaaagaaaatattatagagccagagtgttaaggtttgaatactggctttagacaacatctgaaaaactagaataaaaacagtactgactgataagtaacactacataactcgtaagtgttagctaatattataacaaataatatctttccaaagctctagggtagcatctagctaacagattatatgtttaaaactttaagcattcatcaagttggccaggactaatattgtcatgctattgttaaccagccattatgtcctttaagcaaaatagaggcacttttttaaaaagctaagacagcaacaagatccaatgataggagacttgatgatataaagatcttttctccctcttttctgtagacctgctagctgttgtagtctttctgttcattctctattcttaactatttcccttgagttcagtttgatgaaacctgtgtctgcctatgtcctcatacacaaattctggggtacaatgtaaacctattactgatttcaaccttagtttggagaaaaagtccacattttgtttgcccctccctttgcactaataattttcatggaaactgaaagcccactcttttttttgagatagagtctcactctgtcacccaggctggagtacagtggcgcaatctcggctcactgcaacctacgccgcccacattcaggtgattctcctgcctcagcctccttagtagctgggattacaggctcctgtcaccacacacggctaatttttgtatttttagtagagatggggtttcaccatgttggtcagcctggtctcaaactcctgacctcgtccgcccacctcggcctcccatagtgctgggattacaggtgtgagccaccactcccagccaaaagcacactctttttatactaacttaatcaatcttgagatcctcataagaaatatctagttacccatcttggtctctccatacctagtttctttgtatctacactctgtactgacttgagattctgttaagctcctctatctcatcctagaactaagagaccaaagcaatcaaacaagcatacagttggccctccatatcctcgagggattggttccaggactccctgtggataccaaatccacagatgcgcaagtctcttatataaaatggcttagtacagtcagccctctgtatatgcaggtttgtatcagtagttttgtatcagccatgggttgaatgcttggatgtaaaacccaaagataaggaggactgactgactgtacttagcattacacacagtgaccaagcccatggtagcaattaaaaatcaacaccattgtttccaaacccctgtgtgaaagaaaaagaaaaaagaaaaaaacaatcaacaccagcaataaaaacaaaacaaaacacacacacacatctttttaatcaaaggttcattcaaggccaggagtggtagttcctgactgtaatcccagcactttgggaggtcaaggtgggaggactgcttgagcctaagagtttgagaccagtctgggcaacatagtgacaccttgtctctacaaaaaataaaaacaaaaattagttgggtgtggtgacgtgcacctgtggtcccagctcttgagtggctgaggtggggggactccttaagccccagaggtcgacacagtgagccaagatcacgccactgtacttcagcttgggcgacagagcaagaagacccatctctaaaaaaacacactcccctgcaaaaacaacaaaggtgcaatcaaataagcatatataagcaatttttttttttttttgagacagtctcattctgttgcccagtctggcatgcagtggctcaaacacagctcactgcaacatacacctcccaggctcaggtgatcctcccacctgagtctcctgagtagctgggacaactggcatgcaataccacatctggttaatttttatattttttgtacagacagggtttcgccatgctgcccaggctggtctctaactcctgggctcaagagatccacccaccttggcctcccaaaatgctgggattgtcagcttgagccaccatgcccagccagcaaatctatttagggaactataaaacctctgtcatctgcttacaatgatatgtggaccacaatatttgtattgaaagacaagatttaggctgggcgcagtggctcacatctataatcccagcactttgggaggctgaggcgggtggatcacgaggtcaggagatcgagaccatcctggctaacacagtgaaaccccatctctactaaaaatacaaaaaaattagccgggcatggtggcgggcacctgtagtcccagctactcggggaggctgagccaggaggctggcatgaacccgcgaggcggagcttgcagtgagccgagattgggccactgcactccagcctgggcgacagagcgagactcagtcaaaaaaaaaaaaaaaagacaagatttaaaatgcttattatgtgctctccactcttttagtaaaatatcacaactgatattatgataaacaattgaagctaccagactactctgttttatctcacatttctaatcccatcagttgagtttacataaacaaagaggcaacggtatttgttcccaagccaatttacttcggttattcttgtttgtaaaggcacgtttcaatatttaataaaaacactatgtaaatcaataaaatgtgtgaaaaaatgaagtgaattattatgaatatgactcaaagatatgtgtgatggggggacaagtgtatacatatttaggtactcacttgttccaatttaaagatatgctgattaaagtagtgctgtaaacgttcattagcaaaattaatacagaactgttcaaagctgttattttcataatcttcaaacccaaaaatatcaagaacaccaatagacaatgtctgtaaaacaagagaaagttttgattaaaagtaatgtttaaatttatttaatgaataatatccacaacataagtaacaaaatgctcaattcctctaaagcagtgtacaggggattgtgtttggccagtattcaaaacatatcatgacttaaaagtattttagttatctttatcttacttttatcctaattaaaaaaatatatccaaactgttaatacatataatctatagattacagaaatatgtgaagcaaggttagtggccttttatcttaagaaacctcagaaatccctaacatcttaaagggaatggaaaaaaacagagggtgaggaaatcaaaaggttatttcaatgaaggatcaagagaggtaggttactcctggctataccaagaggacaatgcaatttttcctatttcgacttctacatcccaataaatagaattcttcattaagaaccaaactagtatattttatcagcctcatgaagactgagtgaaactagatgtcagaacgtatggtttcttttttatttttgagacggagtctcgatctgtcgcccaggctggagtacagtgacgtgatctcagttcactgtaacctctgccaccggggttcatgcgattctcttgcctcagcctcaccagcagctgggtttaccatggcatgcaccaccattctggctaattttttgtatttttggtagagactggtttcaccacgttggccggtctggtatcaaactcctgagtgcaggtgatccacccgcctcggcctcccaaagtgctgggattacaggcgtgagccaccgtgcccggccagaacatacggtttcgtaaagttaaaaatatttattaaaaaaaaaaagtatgaggtttaaaatgttgaatagtgctaaaaggattacaacaaaagacagcaatccctgcctcatcatcaagatctgctccctaaagtcaaccacattcaaatctttcagctgtttggtagaatacagaacataaatgcttatattcttctattgcacttctaggaataatctaacttcttactgtggatttggctctaatacctgcatatgaacacttttctcaccaccccaacccattctagaaatacagttgtatgacaattttggttaaatgaaaataatttttctccactggtgctaagagatacaacgggcaaactgatatgatgaatgaaaaatagtaagatcttttttaaaagcctgtactaagagtattttgtttaattctgctaagtctaggcccttaaaaaaattaaaataatgcccttcaaaaataaatcaatttgataaattagattacaatttaaattaatttttatgactgtgagtttacctgaagcatgaaaaattaacataagagcaatttcacatttaaggcaataggattaaatttaaaaggtgacatttttaatcagtctgacaaggtggactagtccatgaaggctgcccagaaaacacaactagatgtgaaatgattaaatacctataatctgccatattaaaaatatagttagaaaaagtctaaacataaaaaaattataattataaaaatataagaataaatattttataatcttgggctagaagaggccttcctctgtaagtaaaatacatatacaaaatgcaaaactaaaaacaagaaaaatgacagaattaactgcaaaaaaattacaacataaaatcagaaaaagatggtataaataaatctaaaaagtaaataactaagagagaaaataattgcaatatatatcaaactataggcctccacaaatatccacaataaatgccttctaaaaaggagtaggccaggcctggtggctcacgcctgtaatcccagcactttgggaggccaagaagggcaggtcacttgaggtcaggtgttcgagaccagcctggccaacatggtgaaacccatctcaactaaaaatacaaaaattagccaggcattgtggcacgcgcctataatcccaggtacttgggaggctgaggcaggagaatcacttgaacccaggagacggaggttgcaatgagccaagatcataccactgtactccagcttgggcaaaaaaaatgagacactgtctcaaaaataaaattaaatttaaaataaaataaaaataaaaaggagtatcaaaaagacaaaacagaagacaaaaataacacaaagttattttaaaaatacagagaagaaataaaatagcgaaaacatgaggtgatgcagaacttttatctatcattaaaaataatgcaataaaatgaaaccattccccttatcagattaggagatgtaaatcctgataacatccaatgtgggtaaaggtgtaggggatcaggtgctttcacacactgctgctggaaatgtacagtcttttttggaaagtgtcaaattttcaaaatgtatctatccttaaacttagcaatcggcagggcacggtggctcacgcctgtaatcgcagcactttgggagaccaaagcagatgaatcacctgaggtcaagagttcaagaccagcctggccaacacggtgagaccctgtctctactaaaaatacaaaaatgagctgggtgtggtggtgggcacccataatcccagctactcaggaggctgaggcaggagaatcgcttgaaccggaggttgtagcgagatcatgccactgcactccagcctgggtgagagcaagacaccgtctcaaaaaaaaaaaaaaaaacagcaatcccactttgataatgttatcctagagaaatgtatacacaggtaagtaaaagaatatttgttacagcattgtttataacaataaaacaaaatctatttttaatggatggatttatggtacacatcttactatatatttataactttttttaaatagccaggtccagatatataatgagacagaaaatatttcaagagattctaggtaaaaaaaatacatatatttatgtttgaaagaatacagagagcatgattctatttacattttttaaagcaactctgaatatacacgttcgggaggtaaaaacacataataaaaaaggtctggaaagacacacagaacaattcttctgaacagggtaataaataacaaataaaagcgatttcttacttattactctatataattctgtgtttttaaatttcatgtattaaccagtttattaaaatagctttcagggaaaaacatattataatccaatatatcattaccttggtattatgctctaaatctttactattcagaagtgcatgattaattcgaaaaactatccagtcaaacagggcactatacagagacttagccatggagttcctcactgtcacagcctgaaaaacaaaagcattacaagtgcatgtagaattgacaatgattaagatactatgacaaagttgtttgctcccattcaagaaagaaacttactatcctgaattagaaatgaatttttctctcaaaataaaaaatctataactaaagttttttgtttgtttgtttttgagagtttggctctcattggccacgctggaatgcaatggtgcaatctcggctcatggcagcctccgtctcctgggttcaagtgattctactgcctcagcttcccacgtagctgggattacaggcatgcaccaccacgcctggctaattttgtatttttagtagaaacggggtttctccatgttggtcaggctggtctcaaattcctgacctcaggtgattcacccgtcttggcctcccaaagtgctgggattacaggcgtgagccaccgcacccagccaattgaagttttccacatgtactcattcaattagtcccactcaaagaatctacgttaaaactgccattaaagataagagaaacaaaatgtaggtcactcagttcaaaacatgtttattaaaaattgggatatatattccccctaggaaagaaggtataattggaagtttacaaacaaatgactttgccagttacagtaggtaagagtattctaggcagaggaataaatctgttaggaaaaagccattaatttctgtggaatcctaatcaccctcttaaaacatacactaatacaaccacaattacattggtagttgtcttcggcttgtcacccatagaaacttctagaattactccatcctcaaagacagcaacaattccctcattatgtagttacaaaatttattttttcctcactctaagctttccaagtttatgaaaattctcaatactatctgctctattttcctgtaagtctgaaattgttcttaaaaaacaaagaatttcaccatttagaaagcataaatttacaaaaaaaaaaaaagggagtagagtatggcacatgtcttacagaactgagtcttagcacttagaagaatataaatcctagtaatttacatatttattatctaggggcttattctgaagcttgtatattcaggtacatatttataactccattttgaagtataaagaaaatagtaataattaagaactagagtatcttccaattccagtttttctacttattctagctgcataatcatgactaagttacttaacctcttaggctactggttatacatctataaaaagaaggtaatactacaacctaccacataggtgatgaattaatttctgaatattgaaggaaaaaaaaagcttcaagttcctagaccaaaaaataactgcctacatagcagaaagaagactggtaccaaattctctatcttcaacactagaaacctgtattattttttattgttgtggagttttagaatatttttaatgtgcaaatggttgaatccttggatgtggaatctgtgcataaggtgaaccaactatcaagaaaaccaatggcagaatgaaaatataacagaataccactgtatttttttccccagaaagaaaagaaaaatgaagataatctaataaaattcaggaaaagtacaatattttaaaactaaatcaacaaatataagacatagaataagcatataaacattatcacaataaattttatgaatgggttgaattttttagttaaaagaccttcagacaaagataaaaactaaagtctaactacagtatttatggtttacataatgtaccatttttataaaataccatagtcatagaatccagataggccaatacgatacctatttgtttactctgtaactccaaattttatactttcagcccttttctctgaaatgcatgtctgtctttcatagcttaacctcaataaacccaaatatcaagtaatattttcccacccaaacaagatctcatttagtgtttcctatgtcattgaagggtaccaatattcttacagctgtgtaaaccagaaatgcaggactcatccttgacacctcctttgtttgccttgcttcccattattcaagtcattactaggtcctgctgatttaatcaaatttttttctttttaaatccatacatttctccctatcaatatgtcaccattctgcaaagcaaatatcattctcactaccgcagcctccgaactcatctctctacatccactcctgccttctgtgcttgaccaaaacccaagatagcccacaagattccctgggggtacaagttctatataattccctcctcataagtgtaggcagaactgtaaatacgatggatttcactcccatatgaaactgatgtcacatgataaaaatgaaaggattttaaagatataaaaacccaaaccagtttattttttaatcaaagggagatcaccccagacttatgacccatggaaactgccaagatattaagtctgtattatattaagttgctaagttgcttacatagctgtaaaaaactaatacattcctccaaatggttctaaacacatctgccagagtgctccttttaaaacaaaaaaacaaattaagatttttttttcttaaaacactttaagagctttgcattacccttcagataaaatactaaaactgtttagtactgttccccatagtacccctaatgctttgcacatttctcggcacaaaaatagagtttttatatatttattaaagaaataacagccgggcgtggtggctcacgcctgtaatcccaaaactttggaaggccaaggcaggtgatcacaagggcaggagttcgagatcagcctgaccaacatggtgaaaccccatctctactaaaaataccaaaaattagctgggcatggtggcgggcgcctgtaatcccagctactcgggaggctgaagcaggagaatcacttgaacccaagaggcagaggttgcagtgagcgagatcacaccactgcactccagcccaggtaagagtgcgagactcgtctcaaaaaaaataaatgaatacaccaaacaaaaataaacaaaaaaaaagtagggaatacaaaataatctcagaaggttacattcaaagttaaaaatgaaaataaatactaaaaaaaatttgtaatgaaaaaggtggtgtggtcattagagaaacgcaaatcaaaaccacaatgagataccatctcacgtgagtcacaatggctattgttaaaaagtcagaaaaacgacagatgctggtgaggttgtggataaaaagaaacatttatacactgttggagggagtgtaaattatttcaaccattggggaagacagtgtggcaattcctcaaggacctaaaagtaaaactactattcaacccagtaatccaattactgggcatatatccaaaggaatagaaatcattctatcataaagacacatccacgtatatgctcactgcagcactattcacaatagcaaagacatggaatcaacctaaatgctcatcaatgacacactggataaataaatgtggtacttatacaccgtggaatacaatgcagcataaataagaagaaaaccacgtcctttgcaggaatttggatgaagctggagaccattatccattgcaaactaacgcaggaacagaaaaccaaacacagcatgttctcacttctaagtggaaactaaatgatgagaacacacggagacataaagggggtgacagagaatgggaggagggagaggatcaggaaaagtaactaacgggtagtaggcttaatacctgggtgacgaaataatctctacaacaaacccccatgacacaagtttacctatataacaaacctgcactataccccggaacttaaaagttaaattttttaaaagaagaaaaaggtagtgaaagaaaatgtaaaaagcaatgaatctttattttatataaaagaaatataaaactcttaaagatttggctttcttttttttttttgtctttttttttctttttattattattattacacttttaagtattagggtacatgtgcacaatgtgcaggttagttacatatgtatacatgtgccatgctggcgtgttgcacccattaactcgtcatttagcattagggatatctcctaatgctatccctccccgcttcccccaccgcacaacagtccccagagtgtgatgttccccttcctgtgtccatgtgttctcattgttcaattcccatctatgagtgagaacgtgcggtgttcggttttttgtccttgcgatagtttactgagaatgatgatttccaatttcacccatgtccctacaaaggacatgaactcatcattttttatggctgcatagtattccatggtgtgtatgtgccacattttcttaatccagtctatcaatgtccaacaaagatttggctttcttttcatttagaaagaagctctcacagtggaagactataatatgacataagaagaaatgtggacttggagatacagaaggtgagataaatggatcaatgtcaagcttaaaaaacattctctagaattcaatcacaatttcctcacctgtcttctaatcttctaatttcatattcctgtccaatttttataattataataatttgacttgacatcactttcataaaactactccacaaagtagcagcttttcaataattttcctgcccctatagatctgagtggtataatagtagcaacaagtatccctaggagcctcagtatacagatggtatttaaagtgatgggactgggtaagataacctcaatgaagaatatagagaagaagaaacaaagactgcgtcctagggtactctaccttttagagataaagaaaaaaaaatacaagcagaaagaactgcaaacaagtagccaacaatgaaaaagttaaccaaaaaagtatgatgtgctagaagaaactgtctcaagaagaataattaattgggtcaaatattgctcatttataattctacctaccatctatctaccccacattagtaatatgaaaattggaaatgatgaagaggttaagatccttggagaaaaatgcaagcctatttctcacaatcacattcaaatttaagtttctaaatcaatggaaaattcacaatcaaatgtaaaggcctagaaaatatttcaatcaaaactttttgccattgtcattttcatgctgttaagagaaaacccaaacttcaaacctaaacttctaacaatgtccagaatgctttcatttcaaagaaaatccatcatacctctgccaacttgtatggcaaaataagcttttctcccactgtcaccgtcttccttgtaactaatgcttcaaatagcatctcttctttaacctataaaacagaaaagtaaactcaatatgtaagatttatgacaataggttgaattatcttttgaaaaagccaaatagaggaggaaaagcttaatgagattagcaattacatagcagagaaaaaaggcaatacactgggcaattttaatactggccaaatggaatttaagtgtcccactcaaaagacaaatgggttttttcaagttaaagtttgctttctgatcataacagagaaacatgtttcattgtgcagaatacagaaaatatagaatagtataaaaaacattttaagatgatcaatcataatcccacatgctggaggcaaggactaaaaagtgacagcacttcttgaattccagaaatattccaaaggatatttatttatgtttcagatatttcttcttcatgaatcttgaattctaggaatattccaaaatatacttatgtttcagatatttcttcttattcatgaatgataaacttttaagataaagttgacacttcctttgttctcactctctccccagaggcaaatactatcatgaatttcacattatcatttcagttaatatttctacacttttacatgtattaaatatgttcataaacactatgctatactgtcaaatgactttaatgtttatctataaagtaccatattgcccatatgttcttcagatctaactatgtggataatttattattattattattttttgagacagagtttcactctgccattcaggctgcagtgcagtggtgcgatctcaattcattgcagcctcgaccgcccagattcaagcaatcctcccgcttcagcctcccaagcagctgggactacaggcacacaccatgtcgataatttaaatcaaccttattcattttaactgctacatagcattgcagcatataaatataccacagtgtgtaatccattctcctctttgtaggcatttacacgatttacaattttgtatgattagaaaataaaccacaatgaatattgttgcacatgagttcaaaagtttctgtgaagaacaaacctaaaagtagaaggttagagcatacatattttcagctttagagaatactaccaaactcctatatataatttttaccaatatgctctctcagcagtagcactgagagttcttatttcttccaaaccttgactatacttaatgttaccagaccttagaattttgtcatgatgatgggcatgaagtggtaaaacaaggacattttataaaagtatccatacataataaaaacataacattcataaatgtaggcaatataaaaatttatcaggtaaaaaatattagattataacagctgtgagtggtagctcacgactgtactcccagcacattaggaggccaaggtgggcggatcacttgaggtcaggagttcaagaacagcctggccaacatgggaaatcctgtcttgaccaaaaatacaaaaattagccagatgtggtggtgcacacctgtaatcacagctactcgggtggctgaggcaggagaatcacttgaaaccgggaggcagaagttgcagtgagccgagaccacaccactgcactccagcctaggagacagagtcagactccatctcaaaaaaaaaaaaaaaaaaaatagattataaggaggagattgagttataaaatgataggaagaggcattatcctgccaccaacaacatatgatagatcaataatcttttaaagaacaacttttaaccatactgaatggataaatattatctagcaaatataacacctttcagagcattcactgatcaactctcaaatttcaaaaactggaaataatttgaggcatattaacttcacaaaaacgcagtaaagccaaaaatcaacaatgaactttaaataaaaggcctcaaccttttagatttatttaaaatacattaaagaacaaaaatatcagattacacaaaaatgacaaaactaacaaagctaagaaaaaaaatgtaataaaatccaaagctatattgtgaggtatattgctgcaattattaaaagtaaatattggctgggtgaggtggctcacacctataatcccaaggcagtaggactgcttgagctcaggagttaaagaccaggttggacaacacagcaagacctcctctctactaaaaataaaatttaatgtgcctgaactcacaagtactcaggaggctgaggcgggaagattgtttgagcccaggagatcaaagctacagtgagccatgatcgtgccactgcatcccagcctggagctacaggcacatgccaccatgaccagctaatttttttttttttttttttagacagagttttacttttgttacccaggctggagtgcaatggcgcaatcctggctcaccgcaacctccgcctcccaggttcaagcaattcttctgcctcagcctcccgagtagctgggattagagacggggtttcatcatgttgcccaggcgggtcttgaactcctaaactcaaacaatccacctgccttggcctcccaaagtgctgggattacaggtgtgggccatcgtgcccagcctcataccatggactcttacacaacaacaaaaaagaagaatatagaatatagaaatcagcattgaaagatctcaaaaacatactatggaatgacaaaaagccaagtttcagaataatatatacagtgtaacatttatataaagaccgaaaacatgcaaaactatgtattctttataaaaacatctatctatactgaaaatatagaaacaagagtaggaatgatgaacaccaaattcacaacagtggttacctctggtggagacagggtacaagggtacacagtgggcttcaattatacacaatattttattacttgagtggggctgtaagggttgattatattgttttctatataatattgtgtgctggcaacatttcataacaaggaaaaaaggaagaaaatatcctaaaacaaattaatatgtaacaagtaaaatgttagaactgatcaatctaaagtccaactctttgaaaacatgaaagatggctgggcacagtggctcatgcctgtaatcccagcactttgggagaccgaggcgggaggatcaccttaagtcaggagttcgagaccagcctgaccaatatggagaaactccgtctctactaaaaatacaaaattagccgggtgtggtggtgtatgcctgtaatcccagctactcgggaggctgaggcaggagaatcgcttgaacctgggaggcagagattgtggtgagctgagatcgcaccattgcactgtagcctgggcaacaagagcaaaataccgtctcaaaaaaaaaaaaaagtaaaaaaaaaataaaagacaaatctcacacaaagcaaaagaaaaaaactaagaaacacaaatagctaataccatagagaaaaattttaaagagtgaaattaacagactatttacaaagaactcaaaagcaggccgggcgcggtggcccacgcctgtaaccccagcactttggaaggccgagacgggcagatcacaaggtcaggagatcgagaccatcctggctaacacggtgaaaccccgtctctactaaaaatacataaaaaaaaaaaattagccggacatggtggcaggcgcctgtagtcccagctattcgggaagctgaggcaggagaatggcgtgaacccaggaagcggagcttgcagtgagccgagattgcgccactgcactccagcctgggcgacagagcgagactccgtctcaaaaaaaaaaaaaaaaaataagaactcaaaagcaacaaattctaaatatccaatacatcatttttagaaaaacatagatcatccaaataactcaagccagatttgaaaatcctaaaaaattagttaaaaaggaacaaataaaagacatcaaatacagttgctcataaggctgacctctctcaaacccttgaggaacatattattctctgctaatgatccttctaattgcagaaaaaggagcaagggtacaaaaactctcaactcatttcatgagttctctttacctagcacaaaaacctgacaaagattgtacatagatctacgcatacccacacaaccccaaaacatactaatcttgcatatcatatttggtaaggatcctaaatattacccaattcacgattttttaatcagctcttctataattttctaaaaattcttaaatatattacttttagaatattcaaaaactattaatacagaacaagtagcaatgggttcaatatccattctacaaagcttctcatatttacctaattaaaaatctgatatgtaattaaaaatctattcttggccgggcacagtggctcacgcctgtaatcccaacactttgggaggccaaggcgggtggatcacctgaggtcaggagttcaagaccagcctgacaaacatggtgaaaccccatctttactaaaaatacaaaattagccgggcatggtggcgcatacctgtaatctcagctacctgggaggctgaggcaggagaatggcttggacccgggaggcagaggttgcagtgagccaagattgcaccactgcactccagcctgggcaacaacagcgaaactccatctcaaaaaaacaacaaaaaaaaaccctattctttatattgtttcaacagatgttaaaatatactcaaaatacataaacctgataaaaactgaacagtttttggtaatgatgatagttctaatatctcacaacaaaaacatcttccacaattacccacaatttatcaactggagcttgttcacctttcaataattttcacaagtatccatgccaaataggcattagtaaaggctcaaaacattcattattgcctcaggtaactacaaaaaaataactgaaaagtaaataaataaagttaaaccactactttaaaaacatttgttcctctattctatatttagcattggattaaatcaccatgggaaggagaggaattaaattaaatcacaactaaagagtctgaatgttaaataatccagtcaatgtgcttatctttgtactctatctcaaccaaagccttaagattgcaattattattatcagtcttaaccaactagaggcaatcattttctaaaataatttctaagtactaactaaagatgggataggtatcttctttagctcctgaactttgaagctattttctttctacttaatactaaacctcagccctagaaccaatccaaactatacacaagaagaaatttaagaagccagggttcaaaagtaagattttctgtcaaatcatatttgccatttgccattgtctttgatactggtttgcccaattctcagaattagatttctctcttttttttaaacctatagctgagttcctctttgagttgcctgaattgttcttatcagtctcttaccaaagaagaaatgatgcactagaaacagaagccctggtttctgctgaactgcctagacttataagtaagaccattagccacaatgccctgtcacaataccaaatgcttgactaaaatatcacctgaaatacctgactaaaatgccatctgttctctggcctttatgatcttcaaaattacaaccctcagataccacactccatctcctggtagaacttctttccagtaagtctagttccaattcaaggtactcccttcccctgcctcttcctctgccaggttatcattccactgaagttaataagcaatgcccaatcacgtacagaaaaaataaacgctgggtggttagataaataagaaagaggtatctattgctctcaaagagcactggagccttacaacagacacaaactaataattaactttatgctctaaaactaaattatgctacgtagaaacaaatgctctgtatttagggagtcagtttagaccacttaaggttaaaccacatgaagtggcctatgaaccaagatttggaagatgaataatattttttaaaaaagcaagttattcataactgtcaaaaactggaaacaaccaaaatgtccttcaacagataaatgaataaactatagcacatctatataatggaatattaccccgtaataaacagaaatgagctatcaagtcacagaaagacatgaatgaatcttttttttgtttctagagacagggtctcgctctgttacccaggctggagtgtagtggcacgatctaaggtcactgcaacctccgcctctggggttcaagcctcccacctcagcctaccaagcaactgggactacaggtacacgtcaccacgcccagctaatttttgtgttttttttttgttgttgttgttgttgtttttagtagagacagggtctccctatgttgcccaggctggtcttgaactcctagggttcaagcaactcacctgcctcagcctctcaatgtgctgggattgcaggcatgagccgccagacataaataaatcttaagtgcgtattactaagtaaaacaaatcagtctgaaaaatctacatattgcatgattcaattatattacatcctggaaagggcaaatctatatatctactaaaaagatcagtggttgccagcagtttagggggagggactgaacaggtaaagcacaggggatttttacggcagtgaaactattctgtatgatactataatagtggacatatgacttcttgcatctgtcaaaaaccaaatagcatgaagagtggaacttaatgtatgcaaatattaaaaattatttaagagattgggggattccacgaaggaatgtagaccatgacaagaaaacagcatgcatgacaaatatatgaaacctcaacaaatagggtggaaggaaaaggtgctgttctaagtaattttggaaatgagtgaagtctgcaggattaaaggcagaaggaattgctcataagcactgtattctagttgaaaaagtcatttcccagaggggtacaggttaacaattttgataccactatacatgtatactggaattaaacaaataagtaaatggatggcagaggacagaagacagctttctcactgttgaagcgggagttcacagataagcaagggaagaaggctagaatgatccacgtggggaatggattacagttggagacattatcatgaactcatgtttacctttatatagatacagatgattacatattaaaatatgtatagatacgtggatatacacaggttagtatatacacacatatatttccttgctatgccagacgatagggcctataagaaatgacaccccatctgatgggataaatctggcaagatgagaaggggtaggcaagagagaaattagctaagaaaacatgataaatcatcactccaggaagaaagaatcaggtaataaaggcccttgatgtaagaagaagcatggtaggagatgagaacctttatgtcctattcaacccataagggaaaaaaaaaaaagtagtatccttttttctccacccacccaaatacccccatcttgaaacaaaataatctaaccaaaatcttagtatgagaagaaatctcaaatatgaagagaaaaattagcatagtcccagaatattacagtccagtgtggaaatattcatcctatccagcaaatttagggactatggatgtctggagcaagtggaggcagaggagaaaacacaaattttataaagattctgccacatccaatagcaaactgaggcaggtatcaggaaaaattagatcttttggaaatgctatttaaaaatagtgcctaataaaagcattattaacagaaagcattaacccgtttacacctacaaaatacacaaaataaaaaataaaaagttacaaagatttgaaatgacaactgaaaatgtaatcactcacctctaataattctgagacaataggcagaacttcaggattacagatatcaatggagtcatcccggtatgtcttctttttgtaacagatattacccaaatgtagtatggctgagagaagagagaaaatcctgggaaaataaaacacaaattatagcttagttgtgtccattcccaaagctcatttcattctaaaattctagttaagcaaattaacctacaaatatgaagtatttagtctttggaaaataagcaatatgggaataattactaaaatttactgagggtttacttatatgtcaggtactgttcaaaatgcttttcatggccttaagtataccacttcttatatagtcatttcaaagggacttctgctattgcctgaatttgtcacagtgtttacagtgttttaaaaaggccatgcctctctaaatgctatttatcctgccaggaatgcttttttcctacactgtttcagatacactgaatcagaattgccaaaggaaaggccttgaatctgtattttttaaatcaagtatcctagctgattttttattattagttatgttgttaaaatgcttttctataccatagtatggtgtttgaggtaaatgggtgtgtgtgtgtgtgtgtgtgtgtgtgtgtgtgtgtgtgaatggggtaaatgggtgtgtgtgtgtgtgtatgtgtgtgtgtaagtatgaagccatgtggggtatattaacctctactgtgaaacaacttcatatggaccctccgttataaatttccctcctgagtcagaagagtatgtgccctccaatcaaaaactaatccctccacttatgctatatatcccatcaactcctgttaattcaggaaccttaggttaccaagtacctccatgtagctaagaacagtatattatgttattgacttatctgacatctcagaggcatttaacacagctaaacaatccactgaaaaactcttcctcagtctccttatatatatacagctttgtgtcacatgcagttattttcttagaataaatacggcttacaaaatttggcttatgaaaatttaacactatgttttcctaaaattaggaagtattccaactaaaacaaagatattgctttaggaacctgagatattaccttaggaacatttgagaggtactgaatcaccatctaacttataaatctaatttttcaaataatttaaagtttttaaatctttgaatcattcacgtgactcacaggaaatacaagtctattataaaaataattaataatgttattctggattaaagaataaactatcaactgaaacataaaaactaatggaagtcaaaagacaaaaacaaattcatgagcctcttttaaaaatgatttttaatagaaattcactaattttcattgaactgtagtttatgtcaccaattgagttggtatgccaacttacatattgtattatttgattttaattgacttctcataaaaagattctagtaaatagcctgctaattaaagagtcataccaatgatgtaagtgcaagcaaacaagaaaacaggagaggtgattttctcctactctcagtatagggtcatcaatcatgaggttaaaaattaacaacagagggcgggcgcagtggctcatgctggtaatcctagcactttcagaggtcaagaaaggcagatcacttgagcctaggaattcaagaccagcataggcaacatggcaaaaaaaaaaaatacaaaattagctgagtgtgatggtacaagcctgcagtcccaacttcttgggaagttgaggtgggaggatcatctgagcctggggaggttgaggctgcagtgagcactccagtctgggtgacagagtgagatgctgtctccaaaaaaaacaaagaaaaaaaaattaacaatataatcagatctgacatattcatcagcacgactctccccttcaaaaaagttataagtaactatttctttctggtgagagccaaggttgagtctttaattttaaataatttgtttcaaatataatttatctcatctttatctcaaatttttatatttttaaattgtttagatttacaattaaaaaacttaatagtatagtacagatataaactatacagaggaaatacactgaaaattaaatactatgcatctgataagtatgcataatttaataagattagagatcactgatatatacaaaatgaagagctataaaaatagtgttacaaagcaaaagttttaagtaaggtccatggataggcttcaggggcaccataaattcctgcatttatatgcaaattgttaaggatgtacattttacaacaacagtgtcagctttcatcagattctcaaaataatttatgataaaaaaaggaattagaaataatgctcgagatggatgaggtactagatgaagaataccacttagaaaactatttaaaaaggtcaacggcagaaatctttcaaagacatatcatgtgttctctattagagatataaaaatacaacaagtaaactcactgtcttcgtgtcttgggaagaaatcctaccatttccatggcaagttgtaggcgctcaaagtcatgtctcaaatcttctccttccaccgtgaagcaatcctgcttatttaaaataaaagtttaaaaatcaagattatatattttaaaataatgtgggccattcagaaatatggtaatttaggataggtacctgtatgtataaatgcaaattagagctggtagaatagtaagacctagtcaaattcattagacctcttatcttactacaggtatggaaactaaacacatacttactaaaataccaataagttacttttgttctccctttcacaatcaccaagattaggatttcaaaagttaacttaagataaagagttagctgtactcagtaagtgtgctgatactaagtttgattttgagtggttctaaagggtttcagaaattcaaagcatttacgggcgctcaattctaccagcaaatactatttattcaacaaatatttaacaagtgcctaccctatgtaaggcactgaactagatattagtgacacaaaaataaattttagaagaggcaataatttagttgaagagtgaaccccagatttacgtaatatagtttgttacatctatctaatctatatttatatagatctatatagatatgttattttttttttttaagacagggtctcattcctgttgctcaggctggagtacagtggcatgatcttggctcactgcagcttcgacctcccgggctcaggtgattctcccacctcagcctcccaagcaactggaactacccagctagtcctaccatgaccggttagttttttgtatttttaatagagacatggtttcaccacattgcccaggctagtcctgaactcccggactcaagcagtccacccacctaggcctcctaaagtgctagaattacaggcgtgagccactgtgcccagcctgttacatctacattagatatatacatatataattatttatatattttatatatgtaattatttcctaatgaaataacagacaacatggtaatcaaacaaggaaagaaagaagtatatgtgaaagtataaaaaccctcagaaaacacatcagatgagtcagtaaaactagttgtgaatagtcacacatgcctgtaatcccagctacttggaaggctgaggtaggaggattgcttgagctcaggagtttgagaccagcctgggcaacacgcatgacaccatctcaagaaaaaaaaaattgttgtggaataccagattaataaatactactttttaagcataatccttgcatttcagttcctaaaatagtcaaacagtggtagacatactctaaatcttcaaaacaataagtgagtcataaatctctttactgtaagttctcacagtcccttgcactttcaaaaacctcctcacatttgcatttacatttttaatgcctatcttcctagggaatattctctcaagtacttggtgaagtatatgaactgttaattgtcttattaactgcagatccccagtgcgaagtcagtgccaaaaacaagtcattatttaggtaaatacatagtcattgaattattgaataatatataaatattgaattgaatgaaacattcctttttcagaaataaagtgctcatttgttttataaaaagtatttatcaagtatttaccatgtacaagaaaatctgttttaggcactgtaagcattagttaatgaatatctaaagtttaaaataaagttttgaaatgctgttaccaatatttttattctctacatggaaagctacacatgcatagtttaaaaatttaaattcaccacaagtaaagttctttctgagaacccatgcatttaattttattactataaaattgctttcgataagcaattttaagacattctactgacatgccaatgtcctactcattaaaataatttttttttgagatggagtgtcgcacttgttgcccagctgctgtgcaatgacgcgatgtctgctcagtgcaacctctgcctcccgggttcaagcaattcccctgcctcagcttctcaagcagctgggattacaggtgcgtgccaccatgccaggctaattttcctatattttttagtagagacggggttttaccacattggccaggctggtctcaaactcctgacctcaggtgatccacccgcctcagcctcccaaagtgctgggattacaggagtaagccaccgtacccagccctaagataaatttttaaacacattcttcttttacctatagtaagtaaccttttgtaaaaagctctcttgctactcttccccctagtctcaaaacacaaacagttcattcactttatgatttaacaaatattttcctattacaagtggcaaggcagggggaatctatgcttccacatgtgtcaataatgattcttctaactaacagtgttctaatcttccccgaaagtgaatggaacaattaatgtatataaaatagtgggaaagtacactgaaagaggcactaaaatatgtttgtatttgctcttatccttaatcaaatgttcttagaaacccaaagtggtctcagtgaatatcaaaatcatagtttaaaaaaaatgtgtattaatttccttctctgtttctctgatgataactgtagaagaaaaactaaggataaattaaatctcccagaacagaaatgactttatcttaatttgggctccctgggaggcagatcttgagacagaccaagagtcaaatacaagtcacagagaaagtgagaaagtaaaagagaagacagactaaacagtctgtgctaactactatgaaagtagttaaatggagtttaatcccaaggttatctctgggaaacaatataaaacctacagaggtgagggagctactgtatttatttatataccatctcatctctcatcagtcattgtttgaagacttctggagagggagcaggcagctgttaattcccaagtcacttctagagggccctacaaatgccaaggccttccagggttctggaaaaagccttcaggccccaggatccaaatactggtcagccagagttcaaggaaatggtaaggttcgttccaaggataaggcagggaactaaccaacaactgttacaaccccttccactgaaagaacataggcaatccttctgtcagctccatataagttcttgtttgtacttgataacatgccactacattccccccacaaacatacccaccaaatgctctttcatgctatcagaccttgctctttctgtaaggtgacacactttcccatttacaaatgcctaggataaacctagcatggagtaggcaattagtgtgggtgtgagggagagaaagagaagagtcaaattagatattttcttctatcttgtctctatttcttaaaattgtacttaagaaatcatactatcttgtctctttttcttttttctttgagatggagtctcactctgttgccgaggttggagtgcagtggcacaatcccagctcactgcaacctccgcctcctgggctcaagtggtccacctcaccctcttgaggaatagctgggactacaggcctacaccacagcatccatctgatttttatatttttttggagggacagtgttttgccatgttgcccaggctggtcttaaactcttgggctcaagtgatctgcctagctcagccttgcaaagtgctgggattacaagcatgagacactgtccagttccatattatatttgatccttataaaacctctggtggtagttatgattgcctttcacacaagcagcaagcagcattggctcacaatttaagccaattgctcctatggtggtgaagcttgttaatagtgtagctgggattccaaccaagcctatgttatttatctccttttttcttaagtgatctccagcatctttactaaccttcaaagtcaattgttccagtttatgtcctgcactctacactagtagttataaaaatgtatgatttcttaagtaccattttaagaaatagagacaagtggccaggcacggtggctcatgcctataatcccagcactttgggaggctgaggcatgcagatcacctgaggtcaggagttcaagaccagcctggccaacatggtgaaaacctatctctactaaaaatacaaaaattagccaggcgtggtgccgggcacctgtaatcccagctactcaggaggctgaggcagaagaatcgcttgaacccagaaggtgggagttgcagtgagctgatatggtgccactgtgctccagcctaggtgacagagcgagataccatgaaagaaagaaaagaaagaaaaggaaaagaaaagaaaagaagagaagagagagagagagaaagaaaggaaagaaagaaagaaagaaagagaaagaaagaaaagaaagaaggaaggaaacaaagaaagaaaagaaaagagaagaaaagaggatgttaagtgctttttttaaatttttttgagacagggtttcactctgcccacccacgctggagtgcactggtgcaatcttggctcactgcaacctctgcctcctgggatcaagtgattctctcacctcagcctcctgagtagctgggactacaggcacgtatcaccacgccctgctaattttttttttttttttttggtagagacagggtttcactatgttggccaggctggtctcgaactcctgacctcaagtgatccacccacttcccaaagtgctgggattacaagcgtgacccaccgcacctggccagatgtgaagtgctttttaaacagaaaaatatatgcagagaaagttgtggagtatgcagagaccttatactagaccggcagagggtaaggaataaagccagaaagacatgtttaagggcgtgaccacaaacttacaaactgacagatgggttttggcagtaggaatctttatactgcaaaaatacttaaaacagagtagatgaaaacattatggtttcagggtatcttgcccaagttgcatcatgatctctgaaagcactataggaggtctacctcataggaaacgagcttccacagatttatagatgtttggattcctgtaaaggtagtagtgaccaaagttggagctttgtctccacagaataatacaggtcaaatccctttgcagcatggtggaaccaacagtgtcctgagactatcacttatggcaatgaccattaaaaccctacctaatagttggaccctaaaattcatggctcagataaataaaagagtttggtgaggctgaccgaccctttacattgaagttactcagatcaggttttttttttttttttttttttgagacagagtctcgctctgtcgcccaggatggagtgcagtggcgtgatctcggctcactgcaaactctgcctcccgggttcaggccattctcctgcctcagcctcctgagtagctgggactacaggcgcccgccaccacatccagctaattttttgtattttttagtagagacggggtttcaccgtgttagccaggatggtctcaatctcctgacctcgtgatccgcccacctcagcctcccaaagtgctgggattacaggtgtgagccactgcgcccagcctcagatcagctttaaggtacaatggcagacatcagccaacatattaccagtatttaattcattctccatattttataactgaggaaacaaaggctgagatgttaataataataaaaataaaaagacatttaatagattattaccacttgaagaggggaaattaacatttattaaatattcttctacatgtcagtcaccatgagttactaaaacctcagaacacaaggagatacttatatatacatttacggaagagaaaatagattcacaggttaaataacttgccaaagcttaaaaaaaaaaatcttataaataacagggctggccaatccaaaatctatgtagttccaaatcctctgctctctcccatgcaacactgctgtttgtgcttatttaataggataacccttaaatggaactaaatcaccacacaagggcaacaacaggtaccttgtaaaaagcaattttctaactataggtctccttgggaccatttatacaattccacgaaatacataagtaatgtagtacaacagaagagtcctcaaacaatcctctctacctatgatgctagtcacataagttctaataactcacagggaaacaaagtttagtttgtccccaaatatattatgaggaagagctaacaggaaagaataaaagatcctcagactgcttgcttttattaattaacataagaaaaacaatcagaaattaaatttcaaactataatagattttaagacacaataaacggataatggtgatgaaagtatgattaagggaagaggagattatggctacaaagttcttctaaagggaaagatgggtaatgatgacttcaatggtggcaacaacattcactatgcacttactaaggattatgtactctatcaagttctttacatgcacaactttaagactcacaaaacttaaagaccattattaacccctaaaataaatgaaactggaaaataagccagccaatatttatgttaggtcattctgcttcagagcccaaatcttttttttttttttttttttttttttttgaaatagagtcttgctgtgtcacccacgctggagtgtaatggtgtgatcttgtctcgctgtagcctcaacctcctgggctcaagcaatctgcctgcctcagcctcctgagtagctggaactacaggcgtgtatcactatacctggcttaaatttttgtagagatagggtattgccttgttgctcaagctagtctcaaactcccagtctcaagcaattctcccacctcagcttccagaagtgttgaattacaggcgtgagccactactctcggcccccaaattcttaagtattacttagactatctctgaaaagtagcagatcagttcacaacttcactgtaagctcagaacagatgatcaagtcttctatttgcagtatgtgtttgcagtcccctacctgctttccaaggaggcatggtcacttggtgtagtacgtgaaaaaggaaaagggggagcttcttaagaatggcaaaaacaacttaaattttttgttaaaatgtatcagaatctataaatttatatgtcaagtgtttttttccccaaaatgttaaatctaaactccaaaattacttggttatgtaatagtaatacaattaaaatttctctaaaaaaaattattattcatgtatactgatcattctcacctgtgaaataagctagtcatgcaattagtaaagtttataaacatgctgtgagaatcacagttgtggttctttaaagcaaggactaagaaatgttttcagaaagaatatttaataaattaattcattaattaatagacataggaagattagtatgtgttttcagcctttttacaagtaacttaattgaaaacttaagaaaaaaatttttgtgttctttatggttacaaacttgtcataaaatataacaaataaagctaaatttagcggggcatggtggctcatgcctataatcccagcactttgacaggccaaggcaagagaatcacttgaggtcagaggttcaagaccagcctggacaacatagtgagactctgtctttaatttaaaaatatacttattaaaatacagtaatataatttttaaaaaattaaagcaaaatgtacctattcactttatattacatcatacatccccttaaatcactcaatttacaacataaaataggctgggcatagtggctcatatctgtaatcccagcactttgggaggccaaggtgggcagatcacttgaggccatgagttcaagaccagcctggacaatatggcaaaaccccatctctactaaaaatagaaaaatcaaccgggcatggtggcgcacgcctgtaatcccagctacttgggaggctgaggcatgagaatcgctagaacccaggagatggaggttgcagggagccaagatcatgtcactgtactccagtaaaagagcgagactctgtcacaaaaaataaatatttaaaaaaaaccttatttataggaatttcaatacttatttttggataattttattaaggctacagactctggctactgggaaaaaaaatcaaagaaaaatatacatgcattcattatgtgtaaagactgttgatatataaaacataaagaatgcaattttttgaaataaacaataattactactcatagtatgtaggtaatgaaactactaaaaaataattttaaaaaataaaaggggaaaaaaaccatagttcatacaaatccacagcaatgatgaagaatcaggaatataatcaatttaatgtttgtcgaaataaatattgaatgtggactaagtcttaatgaccagaaaatagcccaaaaaaagtaaattaactggttttaaatcaacaaactatacagatataaatcaatcattcaaaagaaatgaaacattgatttatcttccttcctaggattctttgtatttcagctgatttgcattctaaatcttcagatggatgcaaatgcgcaatgtgaggaccctttgacagaaacacagaatatttaggtacttgtactgaccggctcagagtcatagcaataatcatcccagctctgtctgaggggtttctttgttatctgaaagtaaggcagattagttaggtagaagtaatggttattatactcttctaatgatctcttagatgtggtgtgcaagtagtactgctgctctccattgaaaagttattttgcatagcagcataaaacaagaaataatgaagcaaatattcacatgctgggagactgtatactgtactaccgaacgcatatataccatgggctccagtgactgttatttatataaactgagtcccatatcctatgaatattgacattatgacaggaatatattatggtcattaattacaaaaagatctgaaagaacagcaaaattccagacttctctaatactaacaactatcagctcatttatgagagaatattactttataaaaaagaaaatctttaatcacccaaatataatgcaaatagtttaaactggggaggaaaaaactcagaagctgaattagcaaatatttttgaaaagctatttaattctatgtgtaaaaattaataatattatatcagaaatggatactttaaataacttggaattctcaatatattaatacaaagtcattagtttatattaatataggtagtttcaaaattaagaaataacagttaatacaacacactgtattaacttggagaaagccaaaggtataactttctttttttcttttttttgagacggagtctcgctctgttgcccaggctggagtgcggtggcacaatcttggctcactgcaacctctgcctcccgggttgaagcgattctcgtgcctcggcctcccaagcagctgagattacaggcgtgcctcaccacacctagctaatttttttgtgtttttagcagagacaaggtttcacgatgttggccaggctggtctcgaactcctgacctcaggtgattcaactgcctcagcttaccaaagtactgggattacaggtgtgagccactgcactcagccaaagatgtaactttcataaccctaaatatatactgctatctgaaccatcatcaaagtgtcaatttgtttacaaaagcttcgtaaggatttttttaatggtcataaagggatttatttccgtagacattacatcttgcctccaacaatggaaaaataaggggagacatctattatttaaatgacctattgttttactaattccattagtgctggttgtaaaatttctgttattatgagaaataataaaattagtaaagtcaatgtaatgaaaagtaagaattactcctcaatgtggaagtttagggatgaattttgagttttgaggaaagatccaaattctctaagtcatttgcctttgatgaccttcatactgaatatttaagaagattgttcattaaattataaaaatagtcatactctaagtcagtgtcatagtatcatgcaaagacgtatgtgtatgagacttcaaaacatgcaaattaggtttcaagtaatcccttgcaaaggacaagaattaatcattagtaacatttaatatcctgggggttgtaaaaggtaaatcactttagtaaaagtaaagcatttttctaatacagtagaaatatcaataaacagcttattattattttcccaaagaatctcacagaaaacgaaaagcacatatattatctgagcttttaacatttatatgaggatggtaatcatcctcaaatttgagaactgcatcacctaaatttgtagagtacatatatgaaaatgctagctaatccattcctaggtttgagaaagtactagaaaaaagacatttttcaagcattaaatttaatactgccctatacttcaaaatgctttttatgaactctcacctgattgagataatgatattcctctggttgcttaagatggaatgctgatctctcatcttcacttgctcctgccaggaggtaatagaatacatgatagttcctgtgggaaacaaagaagtacaagtttcataatgtgtgacttatggttatcatttaacagggggaggggggaagcaaacagtaattagtaaaatgtatcagctttgcttcattttttaatataaatgtgataaattcagcgtttaagtactcctaaaaattgaatgatgttttggatgtggaatacaaaagagagggatgaaggcagcaaagttaacaaagttaggacctctgaaaattctcttctccataaaaccaatgagaaatctggcaaatctgtcataattaaccttttcagaactgtggaaactaatcgaaagcttgcaacaacccagagagtgtttactcaataaaaagagctaaatctcaataaaaatggctttgtagtgttttaaacttgccctattccatccccttgaaaaccaacagcctgcaaacttggagatgagaagcctgacagctaccagaaaggtcagaacagagtttgagcttgttcaaagcctcattccctaagaaatatcattatttgaactgtctggtggttctctgtgaacagccatattcaaggctgactctacaagattcaattcggacttcatatcatgcaaagatcttttccccagaggcatccatagaaactgaggcaatcgctgaacagcctacttcctaaagcagtggatcaaagttggggcaaacaataggctaaccaagaaacttaaaaggaaaagctggctttgaaaacctccagtaaatgtcctgggaatctagaaggtcatatgcatgcataatgctgtggacatgcccagggttgtgtgtgctctcagaaaaataacagatgaaatataaactctcacctctggttaactttgaaaccctgcacaagcagaaaataaaggctaaggtagatttgtgaaatacctagctgagtgttgaaggcatggaacaatatacatagagagccctgtggcaaagagtgagagacttacttattgtttccaagcatttaaataaatatctgtccagttattacctgacatctaagttaaataagcagacacttcaatagccacactcaaaaaagaatatcaactttataaaattagttcagaaaagtcacaattaacaatcagacagtaggaataaaagcaacaatcaaaccctgggaaggagaggactcatttctagagctgccacattatattattttaaaaatcaaattttttggccaggcgtggtggctcacacctgtaatcccagcactttgggaggctgaggtgggtggatcacgaggtcaagagatcgagatcatcctggtcaacatggtgaaaccccgtctctactaaaaatacaaaaattagctgggcatcatgacgtgcgcctgtagtcccagctactctgggaggctgaggcaggagaatcgcttgaacccaggaggcggaggttgcagtgagccgagatcacgctactgcactccagcctggtgacaaggcgagactctgtctcaaaaaaaaaaaaaaatccaattttgttgtgttttgtttcgtttttgttttgagacaggatagctgtcacccaggttggagtgcagtggcatgctcatgattcactgcagccttgacctcctaggcccaagtgattctcccacttcagcctccctagtagctgggaccacaggtgtgcaccaccaaatctggctaatttttgtattttttgtagagacagagtctccccgtgttgcccaggctggtctcgaactcgtgggggctcaggtgatctacccatcttggcctcccaaagtgctgggattacaagcgtgagtcaccacacccagccaaaaaaaatccagttttcaacaacaacaacaaaaaattataaggcatgcaaagaaagaagacagtatagccgatacaaagtagaaaaagtattaattaataactgtccctgaaaaaacccagacattagacttacaagattttaatcagctattttaaacgtgttcaatgaactacagaaagtcacatttaatgaactaaagaaaactatgagaacgctatctcaccaaatagagactaatatacaggactttaaagaaattaatccaaaaagaattctggagttgaaaaatataactgcaatgaaaaagtatccagaggagctcaacagcaaatatgagtaggcagaagaaagaaccagtgaacttgaagaaaaaatcaacaaacatgaagacaggtcaattgactctcgtctaaggaacagaagaaaaaataaaatggagaccacaaggtctcagagacctgtgggacaccattaaaaagactcctatggcaggcacggtggctcacacctataatgccagcactttgggaggtggaggtgggtggatcacctgaggtcaggagtttaaggcagctcacgcttataaccccagtactttgggaggcagaggtgggtggatcacctgaggtcaggagttcgaggccagcctggccaacatggtgaaaccccgtctctactaaaattacaaaaaaaatagctgggcatggtggcaggcacctgtaatcctagctactcaggaggctgaggcaggagaatcacttgaacccaggaggcgaaggttgtactaagctgagatcacaccattgcactccagcctgggcgacaagaatgaaactctgtctcaaaaaaaaaaaaaaaaaagaaaagaaaaaaaggctcctatactgggggttctaaaaggagaaaaaagaaagggacataaagaatacttgaaaaaacaattgccaaaatctctctccaaatttgatggaaaacattaatctgcacatccaagaaattcaatgaactctagagagtataaactcaaatccacattttgacaaaccaaaattcttgaaaggcaaagacaaagaattttgaaagcaccaagagagaaattcctcatcaaggaatcctaacataagattaacagctgatttctcatcacgaaccatggcagacagataacgtattcaaaacgttgaaaggaaaaaaaaattgtcaatcaagaagtatatatccaggaaaaataaaggagaaattagaatactgccagataaacaaagttggacttcacagctatagatggtccttacaagaaatactaaagggagttcatttttctgactgaaataaaaggatactagacaagattcaattaaacatgaagaaataaagaacactggtaaaagtaactacataggtaaatataaaagatagtataaattaattaactcattgattgattgattgacaggatctcactctgttgcccaggctggagtgcagtggcatgatctcgactcactgcaacctctatctcgtttcaagtgatcctctcacctcagcctcctaagtagctgggactacaggcgtgcatcaccacacctggctaatttttgtagagataaggttttgccatgttgtctaggctggtctcgaactcctggcctcaagtgatctgcccaccttggcttccccaaagtgctgggattacaggcaggagccactgcacctggcctattttttatgtataacacttttttcctattaaacttgagaaattacataaagcagtaattataaatgtgttgatggatgtaccaccataaagaagtaatttgcataacaattacaggacaaaggagcaagaaaggaatagaactacatacaaagtttgttgtatactatcaaaattaagttgtcattattccaaactacattgttatcagattttaactacaatgcccaaggtaaccaataagaatataaaaaataataaaaagaaatgccaatgaaattaaaatggtacactagaaaacatttatttaatgcaaaagaaggcaggaatagaagaacagaagaacaaaaaaaaatcgtaacacatatggagaacaaacagcaaaatggtattaataatcctaccttatcaataattacattaagtagatcaaatgctctaatctaaaggtagataaatggcagaatggataaaaggaaaatgtatggtccaactgcatactgtttacaagagacaagctttagactcaaagacacaaataggttaaaaataaaaagatggaaaaaaaagttaccatgcaagcaatatccaaaagcaagctagagaataccagataaaacaataattactaattattactaatatcaggtaaaataaagaccaaacttgttcctagggacaaagaaggccatcttataatgacaaaagggccaatccatcaagaagacataacaatttaaaatatacataaatgtgtgtctaagaacagagcccaaaaaaacattgagcaaaaaaactttttttttgagatggagtttcgcactgtcacccagactggagtgcagtggcgagacctcggctcattgcaacctccaccttccaggttcaggcgattctcctgactcagcctcccaagtagctggaaatacaggcgcatgcaaccacacctggatagtttctatacttttagtttcaccatgttagccaggctggtctaaaactcctcatctcaaatgatctgcctgccttggtctcccaaagtgctgggattacaggagtgagccagtgcacccggccacaaaaagaacttgacagaactaagagaagaagcacacaattcaacaataatactgagagactgcaatactccactttcaataatgaagaaagcaactagacagaagatgaacaagaaaaagaggacttcaaaattactatataccaattagacctaacatatgtttatagaacactccagtcaacataaggaggatatattcatatattttttcaagtccacatggagtatcctccagggtagaccatgtgtagtctactacaaaacaagtctcaataatttaaggagattgaaatcatacaactactccaaacactttgcagtgaaataagaaatcacatttccacggccaggcatggtggctcacgcctgtaacattttgggaggctgaggcgggcagatcacaaggtcaggagatcgagaccatcctggataacatggtgaaaccccgcccctactaaaaatacaaaaaattagccaggcgtgatggcaggcgcctgtagtcccagctacttgggaggctgaggcaggagaatggcgtgaacccaggaggcagagcttgcagtgagccgaaatctcaccactgcactccagcccgtgcctcagagcaagactccgtctcaagaaaaaaaaaaaaaaaaaaaaagaaagaaaagaaatcacatttccaaaatacaaatacatggaaatttgacaacacattcctaaataaccagtgggttaaagaagtcacaagcaaaattataaaatactccaagatgcacaaaaacaaaacactacaccaatacatggaaaacagttgaagcagtgcttagaggggctttatacctgtaaacccatataaaaaagatctcaaatctataacctaaccatccaccttaagaaactagaaaaaaaagcaaactaaacccaaagcaagcagaaggaaggaaataataagcatcagagcagaaataaatgaaataggaaataggaaaaaaaatagagaacatcaatgaaactaaagatcggttctttgaaaagatcttcaaaattaaacttttatctaaactgatgagacagacagagaaagaagcagagagaatcaaattcaggagtgaatgaaagcggaacattactaccaatcttacataaacaaaaaagattgtaagggatactataaaacaagttttggcaacaaattagataacctagatgaaatggacaaattcctagaaagataaaaactaccaaatctgaccacagatgaaacaaaaagtctgaacagatctataataactaaagtgtttcaattaataatcaaaatttcacacaaataaaagtcagaaccagatggctttgctggtgaattctaccaaatgtttaaagaattaacccaatccttcacaaactcttctagagaattggtttgtaaaaactggatttcacctctcattcattctccaaaaccaaggaaataagagttatatacccttatttcattatcattaaaatgtgttagaaaaagttactaatagttttctatctgtaaaatgggaataaataaccaagaagcagaaaagttaaatgagatgcccaaggcatacccaatatttgaatggaagtcaaaccctctcttaaccaaatctcactgtagcatgaaacaaatcatgaatttacttctttatcttatttctccatctgaaggataccacatatatcatctctaaagacctgtatacctcaagtaatacaatggaattaagagctttattgaaaattttttttctcaagttagaaaaagaacactaaggaaatgggagcaaagtcccaaggcacattgctcaccaagaggaatgaggaacaactgagaaactgcttacttgttctgacagtttgcaatagttctatataccaaataaagatctcctagcagcctctgaaaaactgcaaagttctgcccatgacagaaatagcaattatgcataaagctatgcatgacgtaaactgaattaagggtcataatacacaaagaccttaaaagtcagtctgcgtgatacaaatgttaacttcatctaattacacaaataaaaatacgtaccgttcattatgctcctgataaacgagtctggacttctccagtagatatttttcaacataggcactacaagaaaaattaaattggttgatataaataataaagtttaatataaggcagaaaaatatttggagacagtgtaaaagtataaagaatactatccagatcatttcaaaatatgcgccattggccgggcgaggtggctcacacctgtaatctcagcactttgggaggtcgagatgagaggatcacctgaggtcaggagttcaagaccagcctggctgatatggtgaaaccccatctctaataaaatacaaaaattagccaggcatggtggcaggcacctgtaatcccagttactcgggaggctgaggcagaagaattgtttgagcctgggaggcagaagttgcagtgaaccaagatcaggccactgcactccagcctgggtgacagagtgagaatctgtctcaaaaaaataaataaataaataaatatatatatatatatatataaatatatatatgtacatactattataattgtggtatgggtactgttagtgttatccatgttaaattcatatggtcacgagtcttttttctttcactaaagcaaaataaaataagaagtttaaaccaggccaggcgcagtggctcacacctgtaatcccagcactttgggaggccgaggagggtggatcacctgaggtcaggagttcgagaccagcctgaccaacatggagaaaccccatcactactaaaaatacaaaatcagccaggcatggtggtgcacgcctgtaatcccagctactcggaaggctaaggcagaagaatcacttgaacccgggaggcagaggctgcagtgagctgagatcatgccactgcactccagcctgggcaacaagagcaaaacttcgtctcaaaaaaaaaaaaagaagtttaaaacacagtacacaagatccctgaagaaagactctacattatttctaggctatataccactacacattcttccagacatactttggacagattactacataaggctcaaagatatacatagtttctttttatatatttacgctattgtcacagcctaaaatcaatttattatataatgatttactctatagttatttattgggcactatatcaagcacaaggaatatggaaataagtgatctactgcctgttctcaaatgacttacaaattagtagagaaaggagataatctagcagctatcatactgagttgatagggcttattgtagagcaatgaccaggatattatgcgtacacaaagagagacacctgagattcaatccaagaaggaaaaaggatgtaaagaagaattcccatggataagtgagtacacagcacagagtaaactttcattacatatatctggtgaaagagtgactgggtaaatgaattcaaaatctgaaggattaaccagaaggaaaggagaactgcctttatgtaaagttataaaggaaggagggtacacataccaacttcagggaaaacaattagttacgtatcacttaactacagaggtacattctgagaaatgcatcattagacaattttgttgtttgtcagcatcacagagtgcacttatacaaccctgatagtatagcctactacacacttaggccttatcttatagcctattgctcctaggttacatagctatacagcatgttactgcactgaatactataggcaactgtaacacaatggtaagtatttgtgcatttaaacatagaaaaagtacagtaaaaatagggtattaaaatctcataggactaccatagtatatgaggtccatcatctactgaaacatcactgtgtggtgtatgacccaagttacgtatgactagagaatgatataggtggacggactacgatcaagagctactatactatatgccagaagaacgaactttatcctgaaagtaatgaggaattaaacatcaattgtatatctgatatttttttctctttatccagactgtgccctccaagtctttaaaacttcttacccaaatgggtgcaatcagctaagatctcattggaaaggggttctagaatctgaaatgtaaaagctttagattactgaatccaaattattaggacaaacctcttagaggccagaatctgactcttaagctgtatttctcccagttgcctcccaccacatgctatatacttcagtcactcacaaacacacaatccctcaaagattccattcactcctaactgcactgctcactttcttcctcccacttccaattccctagtctattcccagtctctgtccagtaaattgcattccttcattaaaataaagctcaaatgtgggttctttgaaaatccattgccactaccaccaccaataattaaaatttatttctttttctgaattaccattgccatttccagtctaaattaccaaaacaggctcttacctgtctaaaatgggagaaaggaaattaacatgaatatgttaaatcctcacaaccaccttgcgtggcaaatattactgcccctattttacaagtatagaaactgatgctgaaagatattaagatcacacagctagtaaaaagcataacttttaactcaggtttgttttaactacaaaggctctctttttcaactacagtagcccccttccactttattcatgggggatacattctaagatgccaaccacaaataataccaaacccacatatatatcccattctacataatacatatctatatactatatctatatctatatatacatatatatatggtttttttccttgaactttgtttttttggaggagtcttgctctgtctcccagacgatcacagctcactgcaaactccgcctcctgggttcaagtgattcttccacctcagcctcctgaacagctgggtccacaggcacgtgccaccacacctggctaatttttgtatttttagtagagatgggcttttaccatgttggccaggtgagtctccaactcctgacctcaaatgatttgcgtacctcagcctcccaaagtggtgaaattataggggtgcctggcctgcgtcttttcttcctatacatacatacctatgacaaagtttaatttataaattaggcacagaagacagggggccccaacccccagggcatggactcgtagcggtccatgacctgttaggaaccgggctacgcagcaggaggtaagcggccagcaactgagcaaagctgagctccacctcctgtcagatcagcggcggcattagattctcataggaatgtaaaccctattgtgaatcacacatgagagtgatctaggctgcacactccttatgagaatttaatgatatatgtaacaagcttgaatcattccaaaaccattcctccatcccccagtctgtggaaaaattgtcttcgacgaaaccagtccctggcaccaaaaaggttggggaccactgcagtaagagattaacaataactaataataaaatagaacaactaggctgggcacagtggctcatgcctgaaatccaagattagcctggccaacacagtgaaacagcatctctaccaaaaaatacaaaattagccaggtatggtggtacacgcctgtagtcccagctactctagaggctgaggcaggagaatcacttgaacccgggaggaagaggctgtagtgagccgagattgcaccactgcattccagcctgggcaactgagtgagacccttctcaaaaaaaataaataataaataataaaacaattataacaatacactgtaataaaatgtatgtgcatgtggtctctgtctgaaaacatcttactgtactatactcaactatctttgggtaactgaagctgcataaactgaaatcacagataagggtggtggtagggggagtttaaaggaatataggggaatttgctgtacttttccacttatttttgctgtgaagctaccactgctctaaaaaatagtctatttaaaaaaaaaaaactatgaagaatattgctcacacaaccagaggactctgaacatagactatataataagaaacaatattgtaacaaaattaaatttctcgaatataataatatggttatataggaaaatgtagattagaaaataccaacttacttgaaaacaactttttatttttttattttttttgagagacagagtctcgctctgtcgcccagactggagtaaagtggcacaatctcagctcactgcaacctccacctcccaggttcaagagattctcctgtctcagtttcctaagtagctaggactacaggtttgcgccactgtgcccggctgatttttgttattttttagtggagatgggttttcactatatgttggtcaggctggtctccaactcctgacctcaggtgatccacccacctcagcctcccaaagtgctaggattacaggtgtgagccaccatgcttggccttgaaaacaattttttaaaagaacaaatgtatgcataatatatagaaagcaaatgcaacacattgacaacaatcaaatctaggttaagagtatgtgtgactgttacattggtgttaaaatttttctgaggttttaacttttccaaaactaaaaaaagttgacagggaagaattttaatgctgacaccaatgtctgggaatgaacaatacatagtttataaaagggtaaagacaaaaattaaaacatgctccaaagcctacgcctgctaagtagcagtacttacccaagtacagtgcctgtttcctggtaatttacttgaataaacttcccaaaacgacttgaattgttattatgagctgtctttgcatttccaaaggcctgtcaaaataaataattctcattagtttcactaaaaaaaaaaaatttttttttggaggggggattaggtcagctgcttaggtcagctcagagacaaaatgttaaagagacagtaaaaagacaatttgcttgtatgttcagactcattcacagttcaggcaaaatttttttaaaaaaaaagcaattaacaactgaaagaagatcaagtagattttattttgtgctattcagtaaaataaaccataattttattttatgttatttatttatttatttattttggagacagagtctcactgtcgcctaggctggagtgcagtggtgtgatttcggctcactgcaacctctgccttctgggttcaagcaattctcctgcctcagcctcccgagtagctgggactacaggcccacgccgccaagcctggctatttttttgtattttagtaaagatggggtttcaatgtgttgccctggctggtctggaacccctgagctcaggcaatctgcctgcctcggcctcccaaagtgctaggattacaggtgtgagccactgcacccagccaaaataaatcataattttaaaaatgtaatgttctttaaagtttggatttctctttcacattccagagcccccctacaaaaaagtcttaatatatttatacttttactttttaaaaaatttgctaaactgaagtaacaaggagttaggaaaataataattacatcaaaataattacaattttagaatagaatgaaatgaaattccagtacataatgtactatactttattatgcctatttaaaacaaagctagagtactcattacaaaagaataagaactataaacttcctaaatcgtcacccaaagtatgtaccttacaatggaatactgcccaggaataaaaataaactaatgatatcaacaaacactatgctaagcacaagaaaccaggcacaaagtacatatcatataatctatttatatgaaattctagaaaaggcaaaacaagaataacaggaagcagatcagcggttatctgggaatccgggtggaattgagaaatatctacaaaggggcacaatgggtgataaagataatctatagctcaattctgtgatggtggtcacatggatatatacatttatcaaaattcactgagctgtacgctttaaatgtgtagattttattgtaagttatagctcaatatagctcaatgaaatttaagatgtaaatgtttttaaaaatgaagccactgccctagcctgagcaatcacattatacttgaagaaacaaaactagaaaagacacagagatgattcattgcggagcttttttcttctcctacaataatctcatgggaatggcatgccctctaactccaaaatcctaaagtagccatttactgaacacctccctaaatgcaaagctgtttgtgctaaactgtaactgtgcagagcatatatacacggacgcacgcacacatacaagacaaggcgaggacgtcaaccaagctgatgccccggcaactacatctgtactcaagtagtcgtactcaactacaactgtatcatggtcctgagaccagaaacatcagcatctcctgaaaatttgttagaaattcaaattcttgggtccctcacaaaactattgaatgagaaactctgaggataaggtccagcaatctgtgcttataaaacccccttcgagtggttcagatgtaagccaaagtttgacaaccaccgctctacttattatgcatgcatttacatttctgagaaattacattttactatgtcttaagaaattattctataatgatagcagcaaatgcaaagattcataaaaatctccagaaatgtccctcatgaatgtttagattatactgtatcttagtaagtcatggaaaagagcccaggctctcaaccatcaccgaaccatctgcaaactatatacacaaaaaagcttgacattgctgagtcctgaatgcctagaacagtttgtccattctgctttttccctttccaccatagaaagttttttacaaggaatttagaaaaaccacatagcacagattaataaaatgtagaaacaaacagaaacatacatttcatcaaagaaatattcatttaagtgtcaaatgcattacattttgaaaaaacttacaaaataaaaccgtgggcttggagatacgaaatatggatgtgtgatgtactactcttattttcatatatgctacttttgattctgcccaaggctacaatgtcaacagcaaatcagaagctttacctgttacttaacctgtgattgcaatacaacttttatcactacataaagtcatttagggccattttgagaggtaggcttgcaatagttacttcaccaaataagttatatgggtggcaaataagcatgagaaagcatgttcaacatcaccaactattacagaaattccgtcaagaccacaatgagatactactacacacctattagaatggctaaaataatcaacaaaaattgacaatgccaagtgctgctgaggatgcagaggaactagaacactcatacagtgctggtggaaatgcaaaatggtagaacaactctggaagacaatctaacaaaaagtaaaacattcacagaaagttaaacacactcttaacaatatgacccagcgatacccctcctggctatttactactgagaaatacaaatttatatatacatacacatcaaggcacaaacattatcatcagctttttgacagtcaaagcttgaaaataacgaaatgtccaccaacaaatgaaggatttaacaaactgtgattcatctaaataatggaatactactcacaagcaaaataaacaactgccgtattttaacaacctggatgaatttcaaagatacaacactgaatgagagaaatcagtctcaaaactttacatgtggtggttcacatgtgtaatcccagcaatttgggaggccaaggggacagaactgcttgaagccaggagtttgagaccatcctgtgcaacatagggagacctcatctctacaaaaagtttttaaaaattagaccagcatggtggcacacacctgtaatctcagctaatctggaggctgaggtgggaagatcactgaagtctagaaggtcgaggcagcagtaagctgtgactgtaccactgcactccagccagggtgacagactgaaacccgggcctcaaaaaaataaaaaactttacatactataggactctatgtatatgacattctcaaaaacaaaaacagctgcaatggagagcagacaagtgattctgagtcatgaaaggatggcagggcagagggtatgaagataaggagtatcagagttttatacacagaggactataaaaggtaatattttaaattcatagaattttataatatgattacttatttcaaaaaaacttaactcctcaaaatatttattcaaaatataaggcacaaaaaagacaatttcagatatacatagttgaaaatattcatcacaagctaacctgcactaaaagaaacattaaagaagtcatttaagcagaaggaaaattgtatcatattaaaacatggatctatataaggaaggaagaacagcagaaatggttgccccatgaataaatacataaaatattttttagtacttaaatcttttgaaaagatcattgagagtgagattagcaaaaatggcagagtaaggacctctaaacatcctctccttcataaaaggcacaagaatgctgacaaaaactgtcaaactcaaatttttaagaactctggaaattaaccaaaggattgcaagaacccttggcagaggcatttaatcaagaaaaaacagatgagtcttggttaggaaaatcaggcattttaacttgtgctattactactcctttctctttagctccacactgaagagaaaaaccaacatcctacaatgatggggttttttttaaagacacccaagaagccacctgaagaatcagaacagggatggaactcatccaaactccacttccccgagaaaatcatcacaatttgacttatctggcatttccctggaaaaactcacacaaagggtactctttttgtgtgtatgtatgttttgttttgttttgttttgagacaagatctcgttctgtcacccatgctggagtgcagtggtgctataacagctcactacagcctccaacctccaggacttaagcaatccttccacctcagcttcctgagtagctgggactacacacagccatgcaccaccacacccagctaatttttgtatttttctgtagagatggtgggggaagggggatctccctatgttgtccaggctggtcttgaactcctgggctcaagtgatccacctacctgagcctcccaaagtgctgggattataagcatgagccacagtgcctgcccctcatcctacttttttttttgcaacagggtctcactctgtcaacccagactggagtgcagtggtgtcataaggactttcttgaccttacttggaaatcacttgcttaaaacagcctcttcacactccccactgcacccacccaccatcactatgtgtgcttgtcaaaaacaatcagaagcaattgtttaaacactataactgcttaaggtggcaataacagaatggggcaaaaaaaaaaaaaaaaaaaaacaccaaacaacttaaaaggaaaagctggtgaataatatgtacaaaggggactctgaaaacatctgaaatattcatgggcatatggaaggccacgagcatgcacagcactgcacatgcccaggatatgtcgatgctcacaaaacacaggagacctgtgttttgaacttgaggttctttgtaagcaggaagtaaaaggtaaggcagagttgacaaccgcttggctgagtactgaaggggtgagtcaacaaacacacagaacctcatagtaaagactggaggccttaacttcaggcatttaaggaaatccaagtctaatcataactaaccactataactgagtacagtttttgatgatctcatgcacaaaaatatagactttacaaaattagttcaaagaagtcatgaaacaaccaaataacggtaagaaaacaaccacaaaccttgggaaaatctcattttgaggtgccacatcattattattatttaaaaatgtctagttttcaccaaaaaattaagagacatgcaaaaaagtacaaaagtatgggcatgggaaaatgaaaaatagcactaaacagcaaccgttcctgataatgcccagatgctggacttactaggcaaagactatcagctttttttttttttttttctctgagacagggtctcactctatcactcaggctggagtgcagtggcaccatcacagctcagtggagcctcaacttcctgagctcaagccatcctcccatctcagccttccaacagtagctgggactacaggtgcataccaacacatccagctaattttcttttccatttttttgtagagacagggtctcacccatgttgcctaggctggtcctgaactcctgggctcaagtgatccactctccttggcctcccaaagtgctgggattacaggcatgagccaccacacctggccaaaatacagaactcttaaatgcacaaaatatatccaccacgaaagaccatgttctgggccataagtctcaataaatttaaaagagttgaagctatacaacacagtgttatttaacctggccaaaatacagaattcttaaatgcacaaaaaatatccaccacgaaagaccatgttctgggccacaagtctcaataactttaagagagttcaagttatacaacacagtgttatctaaccacaaaagaattaaattataaatcaagaacaggggacagaatctcagaggacaggattggggcagagcaagatgtggaacagatccacagatccactgactgctcccccacacacaaaaagacaccaatttaacaactaactacacacacacaaaaagcaccttcatgacaaccaaaaaccagtagggtaaatggaaacagccatcttagactaagatggaagccatgtactgagaatggcagagccacaaagaaggagcccgtgcccatcactgtacaatcaaccagatcagcccaagactgctaccatgtgtattatgacgtgagagaaataagagtctatcttctttaatcccttattgttttgacctttgttacagcaacctaatgtttgtacaaaagggctttcatttcttacttcattcgtttctgcattgtttgttttacagcatgtataattagtttaataacttaaaatatatacataatctatatatatttacctataagatagatataagtagatatatatctatataaagggagagtgaaatccatatttatccatatagtctatacagaggttagatagatacaatgtgcagtgggccaaagatagagacttttagattttggttttctgatacaccaaaatatttcgaattatttataccttcctgagaattaaattcacaaatctttattgagaattggtcatgtgaaagaaactaaagtgacacaagtatgtcattgttttagaaagtactgtattcactcgtgagtagcaaattaatttcaacaaaataccatccatacttttcaagtaatactgttaatctaaagttcactgatttgaagttccgtttgtacttaatttggcaaaatctgttttgctttatagttgtatacaaactttaaggaaaaaaatttaaatacagttttatatttgtacatttttcagtgtctttaaaatttttgtttatatatatttataataaaataattaggtttccaaaaaaaaccagataggatttaaatatttacaaactaaacacaaatctaagcaacccatggttcaaagaagaaatcaggccaggcacagtggctcatgcctgtaatcctagcactttaagaggctgaggtgggtggatcatctgaggtcaagttcaagaccagcctggcctacatggagaaaccccatctctactaaagacacaaaaattagctgggtgtggtggcgcacacctatagtcccagctactcaagaggctgagacaggagaatcgcttgatcccggcaagtggaggttgcagtgagctgagattgtgccactgtactccagcccaggcgacaaagcaagattctgtctcaaagaaaaaaaagggggtgggtgggatctgtctctgctgttctacgtcctccacctcaggagcccctggtgactttgtcacagcctccgttcctctgtgatctccaggtcctgggagatgcacagctaagaagccaggacatcctggaagctgggaaataaccctgaacctgcagcagcaatctggtctctccatcaccctaggcttgtggaccacaaatcacaacctcatccactgcatggacacaggaatatgtcagaacatagccctgcctgggccatcaagctccaaatagtcatccaactaggagcctcggacaacggccacttttgctgggagcccgtagataggcctctaggaagatctgactgctgtttttccaaaacagtgccccgtcagcaggaggcagttaaaattggtcttcatcctcatccttatccttattctaatggcacttagatgcacttctttagaggggagaatgagacaggcaagtaacaaaaggttccaggagaatctccaactgacctgcataccaggaagacagggtgaagacttgtgaagtctatgccatttgcaggggggaggagcctggcctctcctgtttctgtgtgaagacttgggatcaaattagtgaggtgaacagcctgttaggaggacctcatctcactttcctgaattgtttttccttttcattcattaattttactcctcacccttctatgtgtctgcgagcctaatctttcctggtcgtgtgacaagaacccagtattttccgtttttttgagacggagtctcgctctgttgaccagactggagtgcaatggcatgatattggctcactgcaacctttgcctcccgaagaacccggtattttctacaacaatattttatacatttctttctacaatgattatataattatggcttaccagcaggaaacaaaaaaataaagaataagtcacaaaaaaagaaatcaaaagggaaattatcaaatgttttaaactaaataaaaatgaaaacacaatatgtcagaatttgtgggatagcagtacaagcagtacctaggaaagaatttacagcactaaataaatatattagaaaagaatgatctaaaatcaatgacctcagagatcatactaaaaactttaaaagcttgtaattctagcactttgggaagccaaagcaggtggatcgcttgagcctgggagctcaagaccagcctgggcaacatggtaaaactccatctctacaaaaaatacaaaaattagccaggtgtggtggtacatgcctataatcccacctatttgggaggctgaggtgggagaattgcttaagccagggaggttgaggctcccatttatttgcagggttttatggctacagcatattcttcactcattgcacacatgacagacacctgtacatcttcacctgcgttgtattttccttgtatttatttgcctagttcactttctggcagtttaagatcctcaggaacttcatcagcttctgtcggcagggaaaggcaactatcttgaatgcatatcagttgataatcatgtctctgaatatttggaacatccacgttgtgaacagaaggacaaatatcttcttcttctttttttcccatgaaaacagcaattccaacaaggtgaaccttggcatgaccaagttttccagttttggaagttaacatcttcactattttgcatggttgtcctttgaacatcatgaagtcacttttccgcaaggttgagcactgcatagggtgagtgctggaagccccagcatctccagtagttaaatcaatttcgtacaccatggtgagctggggagatggtagtttttccgtgggaactttcagcaggcaaagagctcctttcacctgcgtacctgcacaggtcccctacagctgcagagccggtggcagcggtggcagccacagcagttgccaataagggaatattatataaaactttatgagaataaatatgataacttagattaagcaagtttcttgaaagacacaaactaccaaagcttactaaaaaaaaaaaaacagtaataataataatcacatgaataactctatatctacttttaaaattgaaaccttgtttaaaattctcccataaaaaacaccaggtccagatggtttcattaatgaattccaacactgacagtaaaaaaaaaaaaaaccagttctacacaactcttccaaaaatacgaggagaaaagacttcccaattcatcctatgagacttgataattctatcaatgcaaaagattgaatgcaaaaaaaaaagacattaaagaaaacaatgttaggcatgatggtgcaagatagaatgcaaaaaaaaaaaaaaaaagacattcaggaaaacaatgttaggcatgatggtgcatgcctataatctcaactatttggaaggctgaagcaggagaaccattgaagcccaggagattgagaccagcctgggcaacactgtgggatccactctcaaaaaaaatttttttaatgagaaagaaaacaatgtccctcatgatgtaattcacattaacaaagtttaaaatataatcatctcaataagacacagaaataacacttgacagaatgaattttgacatccattcctgaaaaaaagctctaaacaagctaggaacagaagggatcaagctcaatgtgacagagaatttacaaaaaaccaacagctatcattataacttaatggctaaagactaaatgttttcccctaagatcagaaacgagacaaggatgttgctttcaaccacctctactcaacattatactggagtagccagtgaaatcaagcaagaaaaaaaaaaaaagacatccaaactggaaagtaagaaaaactttttattcacagacatgactgactatatgaaaaatccaatggaatctataaaaaagctgttgcaggggtgggcaggtgtggtgactcatgcctgttatcccagcactttaggaggccaagacaggagaatcacttgagctcaggagttcaggaccagcccgcctaggcaacatagtgagacctcgtctctactaaaaattaaaaaaaaacacagccgagcacagcaacacaggctgatagtgccagctactcaggaggctaacgtgagaggatcactcgagcctggagatcgaggctgcagtgagctatgatgacaccactacactccagcctgggcaatagagggagaccttgtctcaaaaaacaaacaaaaaaaaaaggttaatggcactaatatttaagtctagccaggttgcagaagataaggtcaacgtgtaactatcaactgtatatctatatactagcaacaaacaattgaaaattgtagaacaccatttataataacatcctcaaaaatattgagagataaatcttaccaaagatgtaaaagacctgtacactaataactataaaatactgccaagagaaattaaagaacttaataaaaagttaaacacatacttatcatctgatctagtcattacattgctagatatttactgaagagaaaaaaatgcatatgtctacataaacttgaatgtaatagccaaaaattaaaaacaacccatatatccatcaatgagtgaacagatctaaaaaattgtgatatcccatggaatactattaccttagcaacaaaaaggaatgtattatcgacatatgcaacaacatggataaatctcaaaataattataccaagtgggagaagccaaatataaaagggtacatactatgtggttccatttatataaaatggtagaaaatgcatactaatctacagtgacagaaagcacttaactggtttcccatatatgggtgggctgagaggagcgtgaaagagggattacaaagaggtatgaggaaactctggggataatggatatgttcttgactgtggtggtggtttcatgggtatatacatgtcaaagtttatcatgttatacactttaaatatacgcagtttactgtatttcaattatacctacaaaatatcttttaaaaagacaacaaagtaatattaccttttcctttcaggtctaaaacaaacactatattccctttccttttttttttttttttttaaattggcaagcaaaaaccgcatatatttatggtgtataacatgatgttttcatatatgtctgcagtgtagaatggcaaaatcaacctacttaatgtatgcattacctcacaatacttatcattttttgtaatgagactaattaaaatcttctcttggaaatgttcacgtataggctgggggcgatggctcatgcctgtaatcccagcactttgggaagccaaggcaggtggatcacctgaggttgggagttcaagaccagcctgaccaacatggagaaacccctactctactaaaaatacaaaattagctgggtgtggtggcacatgcctgtaatcccagctactcaggaggccgaggcaggagaatcccttgaacctgggaggcagaggctgcggtgagccgagaccgcaccattgcactccagcctggcaagaagagcaaaattgtctcaaaaaaaaaaaaaaagaaattttcaagtatataatgtattgttacttaccacagtcatcatgaagtacaatagatcccttgaccttattcctcctatataactaaaaaatttgtgtcctacaaccaacatctctccaatcctcacagcctttagtaactaccactttgctctgtttctatgcattcaactttttcaaattccacatataagtgagactgtggagtacttgtccttctgtattatctttccttttgacattggatggtattacttgtaaaacatcccacaactaaacatttttcccatattctctacattattacaagtttcgatgctaggcacagctgttaagcttgcagaaatacaaatatatcagcaaaaatattttcaccaaccatcacaatgcagttagacacgacctgactctgctttctccccttatagggggatatacaatgactacagtcatctctttctttgcatcattaatgacccaaagacattctctttaaaaaaaaaaaattaccactgtcacactcttcaatcttccacaccaccttttttgcgttcccatcttccaggtcctcttggttactaaaaataatgtctacacttctatttagttttacttcatcttctcacatctatcaaatattttttaaagatatgtttaagaataggaacagtatttttctttctttttttttaaattgctgctccttgtagagcagggctacgctgcaggcagtgtgcccagaatagcaagaacagtatttctatagcttctcagccttttggctaagatcaagtacagttatgtttttatagtttaatatctgaaatgtcttctatccaaagacaattttttttttttttgagatggattttcgctcttgttgcccaggctagagtgcaatggcatgatctcagctcaccacaacctctgcctcccaggttcaaacaattctcctgcctcagcctcccgagtagctaggattacaggcatgcaccaccacgcctggctaattttttttgtatttttagtagagacaggtttctccatgttggtcaggctggtctggaactcctgacctcaggtgatccacccacctaggcctcccaaagtgctgggattacaggcatgagccattgcgcccagccctaaatgagtttttggagctgggagatggaacagtatcttgcttgatctactccacacatcgacctggtattgcagtacctccaggaatggtacacccccccacctcaaaggataaaaatcaaaattaaaatcaaaaataagatttctatatatttacctcaagtactggtccagctccaagaataatctgttctactccactggcaaatcctttctgactgagagcagtaaggtggtgaataagaaagtttgtgctttgagtcttcccagaaccactctctcctgaaatcacgatgcactgattctttttgcgctgaagcatggcatgataagctacatcagccacagcataaatgtggggctcaagttttcccagttggtggttatcatacattttgacatatttggggttataaataggaagaaacttgaatgggttaataactattagaatactgccaacataggtataaattttttcatgcttaaagcgatttcgtaggttttctaagagagttttctcattcaaatcaggtaaactacataaatcatcaaagtctttctgttgaggctgtggaagaaaaccccgttccatcatcctgcgacgttcttctgttacccgtagccatgactgcaggctaccataatggattgatccatcaaggtttttctctctcagaaggaagcggtagtcctctccacttaagcgattttccagagccattcggggccacagcatcattcgctgaactggacaatctgttggattgagaatccattcttctccaccaaattcctttacctctgctagaacataacattttgttttgtcaagatgaagtttgtttataagagactcaatcacctcagcagctgtggagttttttctggcaggaatcggacagtagattgtcccttctgaaatagccccaggatatatccgtaatgtatgttcattatcttcaaagcgtcgtcttcctccatcatttatattcatattggatcctgtcccatcagcatggatagtatatgttcaaagtcgtgcaaaccattttcttggtaaaataactgtaacataaaagatgcaaaatatttagaagtaaatacacattgctttctgatgctcaagaaagaaaagcttaacaagcatgttgattacatcttctaaaacacaaaatactaactcttgtcttagcacagcaacagtttcattgagaccacataatattaagtttcactgtccaaatctaggcactttctaaaatagtaacttgccaaaaaaaacatatatttcaatgttttattatacaaaaatccaaagagtacaaagaaaaattatttttcccctgctgtctcaaatgtttgtaaggaacttgggattagaaccaagttctttccttatacttaacaaagactggattaagacagaataaccatgcaaatctaattgccctgtacccaaaatttcttaaggataaagcaaaaacaagaaagcatcccaacaatggagcaaaaattttgtaaaatttgttaaaaacagcaagaagatagataaacatagaaattacataaaaccaagaaaatgatgagagaaaccaactaaggagatagacatatattttcaaggaattctaggctctgactcactccctcccacaaggtgggaaggagaagggagtttggcaagagtgacaaaagaatcctgcccctgacttgctaggcaaatttaacacaattatacaactaggcaccactacaaattttattcagcttccctttttccttcaatgctaccattatatctttttacctaaccttatttattgcattccttacaagtattctgcattttcttcccatcttctcgaacctcgtatacagtatattacacttctagaagaatgatttcaacttttatacctcactgagaaaatagtgatttccttcaaatggcttctccaactcaaaatttattcctatctttacctcatctatcttattccattcctgtcttctactgagaaaatatgccccacacactttccagggctgataaaacctgtttcttatcttcattagttagttatatgcccccaaaaaactactctcatgtgtcatcaatatttaccttatttatttcatcctttaacatataaggatgatgtgctattaaaaaaataataagaagaaatactttcagttacttcctttttttttttttttttttttgagacagggtcttgttctgtcacccaggctagagtacagcggcatgatcttggctcactgcaccctccatcacccgggctcaggtgatcctctcacctcaacctggctgggactacaggtgtgcgccaccttgcctggctaatttttgtatttttagtagagatggggtttcaccatgttgcccagggtactatctatcctctcatactactacatatttgtcaaagtcttctaatcaagaaactattttttcctgtttgcctagatggtctttcaaacacagagattaatacaaaacatataaaaaaaacccagccatataggccaggagtggtggctcatatctgtaatctcaacactttgggaagccaaggcgggcggatcacctgaggtcaggagttcgagatcagcctggccaacatggtgaaaccctgtctgtactaaaaatacaaaattagccaggcatggtggcacgtccctgtaatcccagctactcaggggcctgaggcaggagaatcacttgaacccgggaggcagaggttacagtgagctgaggtcgcacccctacactccagcctgggtgacagaatgagactgtctcaaaaaaaaaaaaaattaaaaaagaaataaactagtgaggaaaggacaaactattcactgtggtactggttcaattgctaatctgagttggagtgaagaaaattaacagtcctatctcatagcatactgaaaatagattccatctatggatctgtacctatcaatctgttctgggctctatagtctgttccataggtctatttttccacccctgaacctctgttaattactacagtcctataataaattttggtatctgaagggcacattaccttaatgtgttgttctttacaaattttaccttggctatttacactaccataaaaatgtttaagtttgcatgtttactatcgtgaaaaaaaaccttttcagattttaatactgcattgactttacagattaatattggacagaactgacatctaattgactcttctcattcatgaacaccatgctgttggcttttaaaaattacaactatatttttcacttctaaagtttttgtcattttcaaatccacctcatcttttttccgccgatttacatttcaaaattatttatacttaagggctattactccttttctttttgaaaaccctcagtatgtaatttaatatttttcagactaacactgaaatgtcatccagacggaactgctcttatggttatttcatatcttccttagcatgagatgagttcatatatttgagaatttagctttacaagtgcacttttgatggaacttcttttgtttttcatacaaacacttactgagaacatgtttactacttttttaagagaactacagtatcataaatatatttttaaaaattaaaaattttggtattaaatgatcaattgatattcaaatttccaaatttcctcagttatctcataaatatttttcttacagatagtctagctggagattctgctctgcaataacagtgaggatatactctgagttaccaggttcctagttgtatagctatgtttgctttcctgaatccctaagtgtttgcttcatatacgctatggcatctggcagcagtcagcagcaaatcttcttacagccagggaggctgtgacctgtaccactccaggagatgtactaagttaaggggtccccaacctctgggccatggaccagtgccagtccatggcctgtcagaaactgggccgcacagcagaagatgagcagcaggcaagtaagcattactgcctgggctctgcctcctgtcagatcgtcagcagcatgagattgtcatagaagcattaagcactattgtgaactgcatatgcaagggatctaaactgcatgctccttatgagaatctaactaatgccagagaatctaactaatcatctaatacctgatgatctgaggcagaatagtttcatcccaaaaccatcccctactaccccatctgtggaaaaattttcatctatgaaaccagtccctggtgccaaaaaggttaaagaccactgtactaagtaactacaatctaatccctaaagttgtataatatggcagccctggaagtaaacttagaaacatcttttttaacaggagtcctatcttggaccactgtttccaacaataagcccaactctaattacacttccccattacttcaaagcagccaaaatcacacctgctccttcctgaaacagaagtgtttaccttttttgagtcctagttttgtcagtttggttttatctttgttattttatcaattactgctttgtgggtttttttgttttgtttttttttttacaaaaaggagggtttgtctcaaaataccactcagaaatccatcttgatcacaagccagtccttactaaacagcttggaaaatctgtacttgcaaatccgagacatgagctttcatcaaaatcatctggggagctttttcaaaacgtacattaccagccgggtgcggtggctcacacctgtaatcccagcactttgggaggccgaggcggatagatcacgaggtcaggagatcaggaccatcctggctaacatggtgaaaccccatctctactgaaaatacaaaaattagccaggcatggtggtgggcacctgcagccccagctactccggaggctgaggcaggagaatggcgtggaccctggaggcagagcttgcagtgagccaagatcatgccactgcactccagcctgggtgacagagcaagactccgtctctaaataaataaataaataaataaacaaacaaacaaacaaaatttttttttaaatgtacattaccaggctcaacaatagttatgagttgaggaaatgcaggtaattctgttattgctggtccagaaaatagtatttgaaaatcaccatattcccaaatatttgggaactcactttctactcccttaccactcttcccacatagcaagctacttgacaatgctccggagaagtcacaaaattccacagagttggtaatccaaaggtctttcctcattcttcattttaacacaccacactatggcatgactaaagcagccaatttctagttcttgaaagtgtactcacatagttatttttcttgtagtcttcctgatagtcttgctctttttctgactcactcctacagctccttttccattaactcactttattttgttgttgttttgttttgtttttgtatttgtttttgttttatagagccagggtctgtctctgtcatgcaggctggagtacaatggcacaatcatggctcactgcagcctcaaccttctggactcaagtgatcctcctgcctcagtctcccgagtagctgggactgtaagtgcatgccaccgatggcagcagcggcccatctatagcggccactgccatgataccagctgcagtgggggaggtgcagccaggactgcgtgctccatggaggcagcagaagccaggaacaggtgggaaccctgccaccttctgagttgacagggcaggagtttcgtgctccctaggtgcagctgcggccacctgcccaggtgggctgcagacccaggcatcactgtgctcttgggggatgggagcaggcaggagccccaccctcccaggcacagctgcagccgcccaagctgcagctgcagacccaggcatgtctgcactctcagaggcccaggaaggccccccgcccagtccctgcaggctcagaggtgtttgctcccactgcctggcctctcctcactcccagcacccactccaatctcagagaaaggttgggtccgagactgggcactgtcacagcctggccaagtgtgcacacgctccagatagcactgatacaccagccccctgccaccttggccccctctaaactttgggtgcctacaaacactagagggaggctgagggggtactgagggcagctcagtacctgtaggcaccccctgtcacaaacagcctgggcaccatgaacagcaggaggaggcaggcaggctcctgggcaaaaggaggcaggtccctggtgaaaccccaccttcaagccagggaaggcctgaagcctggggaccaggctttccattggcacccgatgaccagagtgggaacttgtggtgctttctccaggctcacccatggttgtcaatgaaccaatcagtacacacaccctccctgctgagacctataaaagcctgaactcagccagacttggggagacaaccacctgccagttgcagagaaaaggtgcccaccccagggtctcctctctgccgggagttgagaagatgatgggacaaccagctgcagggagaagctacccaccccagggtctcctctgctgaaagctgaagagatatccaactaccagctgcagtgaggagctacccactccacggtctccactctgctgacagctgaacactcatcaggacacccgaacactcatcaggacaccctggctgcagagaggagctacccactgcgagtctcctctgagctattctatcactcgataaagctccccttcaccttgctcaccttccacttgtccgtgtacctcgttcttcctgggtacagaacaagaactcaggacctgccgaatggcaggactaaaagagctataacacaaacagggctgaaatacgccccttgttcgtcccattgtaggcaacagaaggagagaagagagaaggagaaaagagctaaggcccttcatggagtccagacctgggggctccccaagccagggctctgacaccctctttggggctctacggttcctggcatcttcaagcttccgagcaccactgcattccccagtgccagccatggaagctgcttgaggtatgcctgatccacagccttgcaaggaagccagcgcctatgccagcacccggagctgcctgccccgctgcagccagcatgctcggttgtgtagagtggccaaactcctcactcactcacacaccctcctttggtaggtgtgggatccaggctggtagtgcaagccaaacacagcctgccattcagagtgatcagaataagcccagcaggcccaagaaaaactcaggcagaggcgccagtggccacagacgtttccagcctgaaaagtatcaccccaagaagtatcaccccatagcaagatggaatgctgcccaggccggtccacaaagccaaaaacttttactatatgctcctttacaggaaaattctgctgacggttgttctagggtagccactaaaaaagacttttttttaggctgggcctggtggctcacgcctataatcccagcactttgggaggccaaggcaggcggatcacttaaggtcaggagatcgagaccagcctggccaacatggtgaaaccctgtccctattaaaagtacaaaaaaaaaaattagccaagcagggtgctgcgtgcctgtaatcccagctactcaggacactgaggcaggagaatcgcttgaactcaggaggcgcaggttgcagtaagccaagatcacaccactgcactccagcctgggcaactgagtgagactccgtctcaaagaaaaaaaaaaaggttttttaagtgtaactttccatgtggcacatatacaccacggaatactatgcagccataaaaaagaatgagataatgtcctttatagcaatatggatggagctggaggccattatcctaagcaaactaacgcaagaacagaaaaccaaacaccacacttataaatggaagctaaaaactgagtagacatgaacacaaagaagggagcaatagacacaagagcctacttgagggtgaagggtggaaggaaggcgaggatcgaaaaactacctatcgggtactgctgtgcttattacctgggtaacaaaataatctgtacaccaaacccctgaaacacacaatttatctaaagaaccaacctgtacatgtactcctgaaactaaaagttaaaaataattatgtataacttttcaactagtagagtgaaaaaacagaataatgagttcaaaagaaagcaagaaaggagaagagaaaaaagtcagaataggtagatcaaatagaaaacaaatagtaaagttttaaagctaaatacaacagtaattatattatattacatgtaaatgctccagttaaaagacaaagatggtcaaagttttaaaattcaactatctgctgttttcagtagacacacatctataacataaggatacagaatcagaaagtatttttttaaaaggagaagaaataccatgcaaacactagccaaaagaaagctggtataatcaaaataacatcaagcaaaacaggaaaataaaattgaattaaacatctcttaagggttttttttagcccttccatactattattttaggcttaggcctgagagaaaggtctctggatatcactggtattcttgaaaagaagtacaaaacagaaaaagattacaagaagttaaggaggaagccacagagtggcaagtaagtagctagcagatgttgatcgaatctgctacaaagaaagcaggagtagggccaggcgcagtggttcacatctgtaatcccagcactctggggggccgaggcgggcgaatcacaaggtcaggagttcgaggccagcctggccaagatggtgaaaccccacctctactaaaaatacaaaaattagccaggcatggtggtgtccgcctgtagtaccagctgcttgggaggctgaagcaggagaatcacttgaacccaggaggcagacgttgaagtgagtaaagtgagtagagatcgtgccactgcactccagcctggagacacagcgagactctgtctcaaaaaaaaaaaaaaaaaaaaaaaaagcaggagtattgtgagtgaaatgtttattagttagggggcttgggaacacaactgtatgattataaataagatcaagcaaggaagcagaaactaaaaactgaagaaaaagaaggtctaactggtaagccaaagttccttggtaagcaagactaaatgagattaaggtcaaaggtggacagatgtctctcagaaaggaaaaaaaaaggacacttttactgaaagaattaaaaaaaaaaaagatgggcagagaaacagaatttgagataagatgtgacgagactgtatatcagctaatcattactagaaagaatataaaagcccaagttttacctatagcagatcaacgtcaagtaaaagcaaaagtgggtgctgaaagaaaacatattttgtaccatttcagttgaagaaaatgtaatggaagaaataaattatcaggctgggcacagtggtgcgtgcccatagtcatagctatttgaaaggctgaggtgggaggactgcttgagcacaggagttcaagaccagcccgggcaatataccaagaccccatctctaaataaataaaatgttaatagttggcaggccacatgtagaatgaaaacctctcaccttatacaaaaatcaactcaaaatggatcaaggacttaaatctaagacctgaataaaaattctacaagataatgtcagaaaaaccctcccaggccttggcttaggcaaagactttatgaccaagaacccaaaagcaaatgcaacaaaaacaaagatgaataaatgggacttaattaaagagcctttgcacagaaaaagaaaaaatcagcaaaaagacaacccacagagtgtaagaaaatcttcacaatgtgtatatccaataaaggactaatatccagaatctacaaggaactcaaacaaattagcaagaaaaaaacaaacaatcccatcaaaaagtaggctaaggacatgaatagacatctcaaaagaagatacacaaaaggtcaacaaacatgaaaaaatgctcaacagcattaatgatgagggaaatgcaaaacaaaataacaatgtgataccaccttactcctgcaagaatggccataaaaaaaatcaaaaaaataatagatgctggcagggatgtggtgaaaagagaacacactttgacactgatggtaggaatgtaaaatacattcactatatgtaaaatacaaccactataaaaaacagcatggagattccttaaagaactaaaagtagggcaggtgcggtggctcacgcctataatcccagcactttaggaggccaaggcaggtggatcacctgaggtcaggagttcgagaccaccctgaccaacatggcgaaaccccatccctaataaaaatgtaaaaattagctgggcatggtggcacgggcctgtagccccaactactcaggaggctgaggcacaagaatcacttgaacccgggaggcaaaggttgtagtgagcccaaattatgccactgtgctccaacctgcacaacagggtatcacccagttgccactactgagtacctacccagagaaaaagaagtcatttatacaaaaaaagatactcccacaggcatgtttatagcagcacaattcacaactgcaaaaatatagaaccagcccaaatgcccatcaatcaatgagtggataaagaaattgtggtcaatatacaccatggaatactactcagccataaaaaggaacaaaataatggcattcacagtgacctggatggaactggagaccattaatctaagtgaagtaactcaggaatgcaaaaccaaacatcgtatgttctcgctcataagcaggagctaagctatgaggattcaaaggtgtaagaatgacacagtgaactttggggacttgggggaaaaggtgggaggtgggtgagggataacaaattgggtatagtgtatactgctcaggcgatgggtgcaccaaaatctcagaaatcaccactaaagaacttactcagctgggcgcagtggctcacgcctgttaatcccagtactttgggaggtcgaggcaggcagatcacctgaggtcaggagttcaagaccagcctggccaacatggcaaaactccgtctctactaaaaatacaaaaatggctgggcacagtggctcacacctgtaatccctgcactttgggaggctgaggcgggcggatcacctgaggtcagaagttcaagaccagcctagccaacatggtgaaacgctgtctttactaaaagtacaaaaattagccaggcatggtgggtgcctataatcccagctactcaggaggccgaggcaggagaattgcttgaacctgggaggcggaggttgcagtgagccgagattgcaccaccgtactccagcctgggtgacaagagcaagactctgtctcaggaaaaaaaaaaaattagccaggtgtggtggcacatgcctgtaatctcagctatttgggaggctgaggcagaatcgcttgaacccgggaggcggaggttgcagtgagcagagatcacaccactgaactccagccttgacgagagagcaagactccatctcaaaaataaaaattaaaaataaaaaaaacttactcatgcaaccaagcatcacttgttccccaaaaaactatgaaaataaaaaataaaacataacgtgaattattgtatgacacactagtatatgtgtatcagcttagcctgaccagtaagtactctgtaccttcttcaaaattactgttttcctttgaaaaactatttctcctccttgtcattccatctttgtcatcgaacatagtttgaatgaactgacctcattccccagataagggagaagagagacatttgctgtgacccaggcccagtcaatcaatttatttcattactcttagccacagtggctgactactgagattctgtactggaatttttgctgcaactgtcggaaaagaagctttcttcccacaccagggccgctaagctagaaagatctaaacctacagctgctggcagccatattccctgaatgcataaaagaaggctctgcaataaaagaaaatgaaactaacacacacagcaaaatcttatcaacatatttgagccactgaatccagttgtgcctcaaataagctagaccactgaaattccttgttaagtgtgccaatcaattcccttttattccctgagccactctgaggtaggtttctgttctctacaatcaaaagaacccattataatgggtagtatttcagtgcaataccctttgaggatacaggtcgcccttgttatccaaattcctgatttcaaaaaatctcacaacctaaactcaagaaccaaatacgtttgagtaaacttctggaatttccttcattatcttgttatttgctatgcaaactttaggaaacaaacagattcaaataaggcagtaccccctgacattcaaattcactatccaaactgaagaattaagcaaacatgaatagtgggagatagctgtaaagtcaaccatgcagaaatatggaaaagaatttataacgtaaaatttttaaatctagaaaattgcacataaaggtatacatatattttaaaatgggttaaaacactgggcttttgggaaatcttcacattttccatctatagttataatcaaaaataagtttgatatacattacctaatttgagttgaacagcaattcttagacaaaaataaactattacctttcaaatcagaaaatcaagacctaaagagcaaaaaaaactatgaaaatatacgataaagatgacatttcaagtcagcagagaaaaaacgattactaaataaatgatgtggggatagctgaccataagaataaaacaatacacgtaaagaactaagcacattactggcatttatatagcaatcagacaatgctgtatcttttatatagaaaattatttaatattctttttattctctatctcaatgtagacacttcaaaagtatatgctaacagtatatgctaacgaggtaagaaagttgctgtggtttagcagggtgtggttcagaataggccagcttatgatgttattcactggactgagttagaagggactaattacagaggaaaactgtggtgaagaaagaaaacagggaataaagagtttcctttaaactagaagttcagttaaagaaattaaaaagtacctaaggatttttaatgcagtgttctgtgcagtgttctgcagtgtgttattaaaatttacttttcaaaatatatacattaattttgtttttgcttttttatcaaaaactttgattctgctttagaagttttacataaattaaaatctttatcaaatgttaatatgaagggaggcacaggatgcaacatatatagtcaagttacctctctgtatatttagaaattactttctcctccaaggtatttgcaacagaaagctctgtctgtcctgcttaataatcagtagtacaggttggaatcaaagttcctcttggggaaatggcaagtctttaggacaggcgagaccctgtatgaatagtaccaaagcattactgcatggtagagaacacactcaattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcactgaaaatctgcacaattcagtttcagctctggattacttcagttgacctttgtgaaggtttttatctgtgtagaatgggtgtttgacttgttttagcctattacgtttttattttctttcactctgtattaaaagtaaaacttactaaaagaaaagaggtttgtgttcacattaaatggttttggattggctttttttagtgaggctttctgaacattgagatatcctgaacttagagctcttcaatcctaagattttcatgaaaagcctctcacttgaacccaaaccagagtactcttactgcctcttttctaaatgttcaggaaaagcatcgtcagttcagtcttttcagaatgagggagaaacatttgcctgccttgtaataacaagactcagcgcttatttttttaaactgcattttaaaaattggatagtataataacaataaggagtaagccaccttttataggcaccctgtagttttatagttcttaatccaaacattttatatttccttcttttggaaaaaacctacatgctacaagccaccatatgcacagactatacagtgagttgagttgcctctcccacagtctttgaggcgaattacaaaagtccagccattatcatcttcctgagttattattttgaactgatttttttgtacattttggctgcagtattggtggtagaatatactataatatggatcatctctacttctgtatttatttatttattactagacctcaaccacagtcttctttttccccttccactgtcttctttttccccttccacctctctttgcctgtaagatgtactgtatgtagtcatgcactttgtattaatatattagaaatctacagatctgttttgtactttttatactgttggatacttataatcaaaacttttactagggtattgaataaatctagtcttattagaaaataaaaaataaaaataaaaaataaataaaaaataaaagagccactggtgagggtaggaaagacagtcttgaactgccaacaccaccctatcctctagcagcagccatgttgtccagagacagaatctgtgtacctgtgggagagatagcacagagattgtgggactttgcattgaaactcagtgctgccccgtcacaggagaaagcagcacagggcagaattcagccggcatctatggagggagcatttagacgagccctaatcagagaggaattgtccatcccagtggttggaacctgagttctggctagccctaccatggcaagctaaagtactctgggatcatacataaacttagaaggcagtctaggccactaggacttcaattcctgggcaagtcttggtgttgtgtgcacttggaatcagtggacttgaggtgcacatgacccagtgagacaccagctagggcagcccaaacagtgcttgcattacccctcccccagcaccaggcagcacagcttgtagctccaggagaacctccttctgcttaaggagaggaaagagtcacgttgtcttacaacttggatatcagctcagccacaatacagtaaagcaccaagcacagtcctgatgcccccattccaggctctacatcccagataacattcctagacacaccctgaaccagaaaggaaccagctgctatgaaaggaaagacccagtcctggcaggatttatcaactgctgcctaaagggtccttggaccttgaaaaaacttcagtagccagcagtggccaggcagtactcgccatgggccttgggagagacccagtaccatgctaacttcagatgtaacccagtgcactcccagctgtggtggccaccgtgagagactccttctgcctgagaaaggagagagaagagcaaaaatgactttgccttgcaacttgggtatcaactcagctacagtaaaataaagtactaagcaaactcttaaagtccctgattttaggccttagctcatggacagcatttccagacccaccctgggccagaagggaacccattgctctgaagagagacccaagcctggcaggattcaccacaagctggctcaacagccttcaggccttgaaaaaacatcagtggtaagtaggcagtactcaccacaggcctggggaggtggtagccacagggagagactccttctgcctacggaaagaagaggaaagagtaaaaaggactctgtcctacaacttaggcaccagctcagccacagaaaaataaagcaccaaggagattcctaaagttcccaactccaggccctagctcccagccagcatttccagactcaccctgggccagaagggaacctatctccctgaagagaagcacaggagcctgtctgaattcactacccactgactaaagcaccctaggacactcaacaaacatcaatagtagccaggcaatagtcaccacaggccttgggcaggaccccgttttgtgcagacttcaggtctgacccagcacagtccaagaggtggtggtcacggcggtgcttgggtcacacctccccaattccaggcagctcagcaaggagatacagactccactagtttgaggaaaagtaagggaagagaacaagagattctgcctggtaatacagagaattctgccagaactaacccagaccaccaaggcagtacctctacgagtctgcaaaagccacagtgttactggggcttggggtgtaccctaatgaagagacagctacaataaccaaagacagatcataatactcaatccactttgaatacttgaaaaccttctaaaggaggacaggtacaaaaaagcccagacagcaaaggttacaacaaatacctaactcttcaatgcccagacaccaacgaacacccacaggcatcaagaccatccaggaaaacatgacctcaccaaacaaactaaataaggcagcagtgagcaaacctagacagagatatgtgacctttcagagaattcaagatacttgttttcaggaaactcaacaaaactcaagataacacagaaggaattcagaatcctatcagataaacttaacaaagactaaaataatttttagaaatcaaacagaaatttgggagctgaaaaattcaactgacaatctgaagaatgcatcagagtctctcaacagcagaattggtcaagcaggagaaacaattaatgagcttgaagacaggctacttgaaaatacacagaggaagacaaaagaaaaaagaataacataagaataaagcctacaagatctagaaaatagcctcaaaagggcaaatctaagagttattgaggctgggtgctttatcacacctgtaatcccagcaatttgggaggccaaggtggaaggattacttgggcccaggagttcaagacagccaggacaacatagagagatcccatctctacaagataaatattttttaattaactggatgtggtggcacaagcttgtggtcccagctactaaggaggctgagatgggaggatcacttgaacccaacaggtcaaggctgcaatgagccgtgatcgtgccactgcactccagcctggatgacagagcgagatcccatctatggagctatagtaaccaaaacagcataacaacagacgaatgaaacagaatggagaacccagaaatgaatccatacatctatagtgaattcatttttgacaaaggtgctaagaacacacactggggaaaagacattctcttcaataaatggtgcttggaaaactggacatccatatgcagaagggagaaactagacccctatctctcaccatatacaaaaatcaaaattagaatggattaaagatctaaatctaggacctgaaactctcaaaccactgaaagaaaacattggagatctctctaggacattagtctgggcaaagatttgttgagtaataccccaaaagcacaggaaaccaaagcaaaaatggacaaataggattacatcaagtcaaaaagcttctgcatagcaaaggcaacaatcagcaaagtgaacagacaactcacagaatgggagaaaatatgtgcaaactgtctatctgacaagggattaataagaatatataaggagttcaaacaactcaataggaaaaaaatctaaaaatctgattttaaaatgggcaaaagactggaatagacaatgagatattatcttatcacagttaaaaagcttttatccaagacagacaacaacaaatgctggcaaggatgtaaagaaaaggtaacacttgtacaccgttggtgagaatgtaaattaatacagccactataaaaacagtttggaggttcctcaaaaaactaaaaacagaactactatatgatcaagcaaattaactgctaggtatatacccaaaagaacggaaatcagtatatcaaagtggtatctgcactcccgtgtttactgcagcactattcgcaatcaccaagatttggaatcaacctaactgtccatcaacagacaaatggataaagaaaatgtgatgcatataatacaatgaagtagtattcagccagccataaaaaaagaatgagatcccatcatttgcaacaacatggatggaactggaggatactatgttaagcaaaataagccaggcacaaaaagacaaactttgcattatctcattcatttgtgggagctaaaaattaaaataatttggactcatgaaaataaagagtagagtgatggttatcagaggctgggaagagtagtaaaggggcggaggaaagtggggatggttaatgggtataaaaatatagttagaatgaataagatgtagtatttgacggcacaaaagggtgactacggtcaacaataatttattttacatttaaaaataactaaaagaagtataattggaatgtttgtaacacaaagaaatgataaatgcttggggtgatggataccccatttgccctaatgtgattattatacaccgtatgcttgtcaaaatatctcaagtaccccataaatatatacaactactatgtatccataaaaattaaagttttaaaaagcatagatggggcagagaagaagggattgactgaaacaagagggaactctctggagttaacggaaacgttacacttatttttggtggtaattacaccagtgtataccatttcaaaactcatactgaacatttatgatctgtgcattttattgtatgttgtttctcagttaaaatgaattttaaaaagataccgccacacatctaagaataaaacaaaatatacgtaaggtcgcaagaagacctaaatacatggaaaaatatactatatccaataatttgacttctgtatcattaagaagccaactctccctcaaaatgatctacagattcagcacaattccaaacaaaatactagtaggttctgaacaaattaacaagctgattctcaatgtgtatttgaaatctaatggacctagaatagccaagacaatcttaaagaataacaaagttggaggacttatactaccaaatatcaagacttagtacaaagccacaaaaagtatagtacttggtacaaggagagacacaagagaatccagaaacaggctcctatacaatgatgttctaacttaaaacaaagatgccactgcaattcagtatgggggaaggaaaggcttctatgtcaatggtgctgcaccaactggattgtctagaaaaattaattcatggacaaaaattactttatgatggatcatagaccatgaaaggtaataaaattaacatttctagaatagatcaaatgagaatatttacatgagccaggcacggtggctcatgcctgtaatcccagcactttgggaggccgaggcaggcagaacacctgaggtcgggagttcaagaacagcctgaccaacatggagaaactctgtctctactaaaactacaaaataagccaggagtggtggcgcatacctgtaatcccagctacttgggaggctgaggcaggagaatggcttgaacccgggaggcggaggttgcagtgagctgagatcacgccactgcactccaccctgggcaacaagagcaaaactccgtctcaaaaaaaaaaaaaaaaagaatatttacatgaacctagagtgggatctcgaacaacaacaacaacaaaaaaaacacactaggtactaaccataaaaaataataaatttgactttattaaaattaagaacttctattcaattaaaaaaatcattgagagtaaaaaggcacagaagatacctgcaatacacatatcaaaaaaaagacttatatccagatttttgtaaaaacagctaaaaaataagaaaactgcccaatctttttaatgagcaaaagacttaaacagattattatgaggatatataaaaggccaatatggatataaaaaataaaattcaacatctgtagtagctcattgttcaaaaatattcacttcttatccttacatgcattgaagacttatacttccgcaaccatgaattttggctacaccacaacttagtttaaggagtggaaggtcagcagacatgacataaacacgtcttgaaatatgcttgaacaactggatatgacttcttgcatttatgttaccactatgaaaagaacatgtcccatctggcctactggtgcacataagaagatgagatacacacagcagagctgtcccagctgacccacaaatccttaaccaagaaacaaatacttgagtaccactggagattttcaggttaagcagtaatagctgactaatacaggccaagtgtggtggctcacgcctgtaatcccagcactttgtgaggccaaagcgggtggatcacgaggtcaagagatcaagaccatcctagccaacatggtgaaacccgcctctactaaaactacaataattagccgggcgtggtggtgcgtgcctctagtctcagctactcaggaggctgaggcaggggaatcgcttgaacccgggtggtggaggttgcagtgagcagagatcacaccactgcactccagcctggcaacagagtgagacttggtctcaaaaaaaaaaaaaaagaaagaaagaaagaaaaaagccagataaaagagtacaaactaaattatcccatttatatgaagttcacaaacagacaacataaatctatggatacagacaccagaagcatggtttccttagcggagaggaagttatataggcagggcacaaaaggaaggccttacaaagttttataaacattctatatcttaatatgggtggtggataaccggtatatacatatgtaagaaatttttaactgtaaatactgaagatttatgcactttattgtatgttacatgggaactgcttgaacccgggaggcagaggttgcagtgagctgaggttgcaccattgctctccagcctgggcaacaaacagcaaaactccgtctcaaaaaaaagaaaacaacaaattagttatttgtggtaaaaaggaatctgagggaaaaaaagaaataaaagagattggttatttgaagttaaactggtattccatataataaatgtattattatactgcaatcattacattatatattacaatatataatcatatattaatacattatataatatataggtaatcattagcaatattgataattatatattacataatataatcttatatgatataatctattaactatattaattacataaatttatattataatctaatatacttattaaatatattaatattattactatataaattaagactgtctcaacattatattttaccataatcactaaatacctgagaaaagtacaaatattagcatctggtttaaatattattcccaatactaattaattaatttatttcattttattttatttttgagacagtctcactctgctgcccaggctggagtccagtggcgcagtatcgactcactgtaacctccgcctcagcctcccgagcagctgggattacaggtgcctgcccacacctggctaattttctgtatttttagtagagacggggtttcaccatgctgaccaggctggtctcaaactcctgacctcgtgatccacccgcctcagcctcccaaaacgctaggattacaggcgtgagccaccatgcccagcctccaatatttatttttaaaatattacactatttaaacagtttcaaaataaactaaccttttgcccttctactgggacgccacatggagactagactataaccaaaacatgaatcttaaataacttaaaatctctccctccacaagacatatttctattgtttgcaaaatgagattttattttcttgataaaacagtgtaatataaagtacttagaaagcttctgtgcttttatccatttaagtaatacaattccagaagcttcaaatgtttactcattctattaaaaatcttttaaggctataaaaaaaaattcatattgttttactctgcaaatcttctactctgtagaaaccccctcaagtttactcataagaacaacacaaagcagagtttaacagaataactaaaaaccttagaattcttagtgaaaatacataaaaactattagtaattataaatgattttcttttctaagtcatttattctgagatttccttttactagtttaacatacttgcctataggactatcaaatcgcccttcgacagtccttatagaaaataagaatatttccaacagctttctcactaggcttccattctctacataaagatattaagtaaacatgcatctagtgagtcctatgagataaagaatgtcctacacctaagcagtacttctctgaaattctgtaatatttattttactaatttttttaaaaaaagctttattgagaatatatagttggacactgtgctgtgtgctttatatgtattacttcatttaataagaaatatgtgatattatacccatttctagatttaaaaaactaatgccatagatgtgatgttcccaagatactacaactactatgttgatgattacaaactagatcccaatttctcttttttttttttttcctttttgggacagggtctcattctgttgcccatggctcactgcagccttgatcttcctggctcaagccatcctcccacctcagccccccaggtagctgggactacaagtgacagccatcatgcctggttaattttttttatttttatttttatttttgcagagacagggtctccctatgttgcccaggctagtcttgaagcctgggatcaagtgatcctcccaccttggccccacaaagtgctgggattacaggtaagagccaccatacccagccatatcccaatttctttaccaatatgctactcttagcacaaataagaaccatggcaataattaatgataatgaataactgcatcaaacactcatacagcatttactgtatgttttaatcattccatcctcataacaaccctaaggaaaggcacactattatgtcttattttacagatcaagaaactgaagtacatagactttgccacttgtctaaggttacaggccagtacatggcagagctaggatgtgcacatcagcagtccagccctagaatctgggagctaaaccactatgccactttgcctttcacaaactgccttatactgcctcatagctgataaggtatatatcatatctcctttatgaactcacaagctcttaggtagcaaagaccaagacttctaacctaatcagcattagacttttgccagcatagggactggtaaataataaaaagaaactagaaggtgcactgaggtcctaaggaaagcttctttgtagtagtgactcttgaggttaaccttgccactgaactctacaattgtatatgtaattgtttagtgcatatttgatagtctcccctactagtatataggcttgttaagggtagaatatttttttgtctttccatctgctatacaacattcaaaaataaataaaataaataataaaataataaaaattcaaaatgtttgttgaataaatatgtgaaaaactttattacagagggttatacttcacaatccctactatcaacagaatcaatacaagatctctagataagagattcacagcaattaaataatttgtgacaaaccacttatcaggttatggaagcagacaggagaatagaaaaagatagtgatagaaggtagaaacatgtattacttaaacccaacagtaaatataggagcaaagtaaacagtgactcttttttctcctttaatttgcatactcatgaatttttatccctccttcattttctttcagaatacccttcagttgagtacctcttctgactttcaattagaatgggggggtggggcgcagggccgggggaggctggtgtggtggctcacgcctgtaatcccagcactttgggaggctgaggtgggtggactgcctgaactcaggagttcgcaaccagcctaggcaacacggtgaaaccctgtctccactaaaaatacaaaaaaaaaaaaattagctgggcatggtggcggcatgcacctgtagtccctgctactcaggaggctgaggcaggggaatcacttgaacccgggaggcagaggttgcagtgagccgagatatctccactgcactccaacctgggtgacacagtgagactatgtctcaaaaaaaaaaaaaaaaaaaagaatgaacgtaggcccagcgaggtggctcatgcctgtaatcccagcactttgggaggccgaggcagatggatcacctgaggccacgagttcgagaccagcctggccaacatggtgaaaccccatccctactaaaactacaaaaaaaaaacaaaaaactacccagatgtggtggcacacgcctgcagtcccagctactcgggaggctgaggcaggagaatcacttgaaccggaaggcagaggttgcagtgagcagagattgtgccactgtactctggcctgggcaacagattgagactctgcctcaaaaaaaaaaaaaaaagaatgaggggcaggcctcaatctacgggttaatccacttatgagctctacaaatatctgcacattttggaggccttgttgacaatatagatatactcaatgacacaataaaatactgagacttaggcaggagaattgcttgaacccaggaggtggaggctgcggtgaaccaaaaccgcgccactgcactccagctgggcaacaaagtaagattccatctcaaaaaagaaaaaaagacacagtaatcaatggaacagaatagagaacccagaaacaaagccacatacctacaaccaactgatcttcaataaagttgacaataataaacaatggggagatgacaccctattcaataaatgctgctggaaatactggctacccatatgcagaagaataaaactggacccctacctctcaccatatacaaaaattaactcaagatggattaagcacttaaatgtaagacctcaaactatagaaatcctaggaggaaactagaaaaaaaattcatctgaacatttgcctaggcaaagaatttatgactaagacctcaaaagaaactgcaataaaaccaaaaactgacaatcaggcttaaactaaagaacttctgcatagcaaaataaaaatatccacagagtaaacagacaacctacaaaatggtagaaaatatatgcaaactatgcatctgacaagagactagcacctggaatctataaggaacttaaatcaacaagaaaaaacaaaccatctcattaaaaggtgggcaaaggacaggaacggcacttctcaaaagatgacatacaagcagccaacaaatatgaaaaaaatgctcagcatcactaatcatcagggaaatgcaaattaaaaccacagagatatcatctcacaccagtcagaatggctattattaaaaagtcaaaaaaataagagatgttggcaagtatgtggaacaaaagggaacactcacacatttggtagaaatataaattagggtcaggcgcagtggctcacgcctgtaatcccagcactttggcaggccaaggcaggtggatcacttgagatcaggagttcaagactagcctggccaacatggtgaaaccccgtctctaccaaatatacaaaaattagccaggcatggtagcacacggctgtaatccccggttacagaggcaggttacagaggaggctgaggcaggaaaattgcttaagccgaggagacagaggctgcagtgagccatgatcccaccactgcactccagcctgggcgacacagcgagactccatctcaaaaaaaataaaaataaaaaagaaatgtcagttagtttaacccctatggtaaacagtatggagatttctcaaagaactaaaaattaaactaccatttgacccagcaatcccactactgagtatctacccaaaggaaaataaatttttctatcaaaaagatacctgcttagccaggtgtggcggtatatgcctgtagtcccagctattcggaaggctggggtgggaggatcacttgagctcaggaggcagagaggttgcagtgagccaaaatcataccactgcactccagcctggggtgacagagtgagagcccatgtcaaaaaaaaaaaaaaaaagtatatataatatacataaaagagaaaaaagatacctacattctttttcttttttttttggagacggagtcttgctctgtcacccaggctggggtgcagtgccgtgatctcagctcactgcaagctccgcctcccaggttcatgccattctcctgcctcagcctccagagcagctgggactacaggcgcccgccaccacgcctggctaattttttgtatttttagtagagacggggtttcaccgtgttagccgggatggtctcgatctcctgacctcgtgatccacccgcctcggcctcccaaagtgctgggattacaggcgtgaaccacagcgtccagccaaaagatacctacactcttatgtttatcacagcactattcacaatagcaaagttatggaatcaatcatcaatgtaagtgcccatcaatggcagattgagtaaagaaaatgtgatacatacacaaaatagaatatcacactaccataaaaaataatgaaatcatgtcctttgcagcaatatgaatgcagctggaggccattatcctaagtgaattaatgcagaaacaaaatgaaataccaaatattctcacttttaagtgggagctaagtagcgggtatagatggacataaggatgaaacactggggactccaaggagtgtgaggaggggaggagggaaagtctgaaaaactacctattgggtattatgttcactatttgggtgatgggttcagtagaaacccaaactccagcgctacacaatatacccttataaggaacccgcacgtatacaccctgaatctaaaatttaaaataaaaaaaaagacaccttcactcatatgtttattatagcactagtcacaaatagcactgttcacaagtcatggtctcaacttaagtgtccatcaatggacattattattctctgacctccctataagtagacatatttccctttaagaccagtcatggttagtaatcaattcttactgaatcatcctctaataatatggatacttaggacagtatggagatattaacaaaccatttgttcccacaagctgaaactaagccattacttaccacctttcaagtgtgaccatccattactacattaatacattcacctctaaatatcattaagactcagatcagcaacttgtaacatttgccccaaatacttaaaaatcattcacttggttcctgtaacaaaaatggatcagaagaggtaattatttcaaccaactaccgccacaattgtcagggtccatggaacatcaaaaaattataacaaaataataccatcttgcaacagccattgtatctaggcatacccctgctctttgttccatagagtcaacatataactcttattcacatctcaaggaatctaacttaaaatatattccatggatgacctcctaaaaactgaaagaaatttagattaaaaagagccacactttgattgaacaaatacatacctatagctgagattagctgtttaacaatggttcaacatggcaatgattttatagcaaaagtccctggggagttataaaaacagaaacctagcactgatatacagtaatcttctgatataatttgatatacagtaatttggataactcttacagaccaaattgaggtatctactaaccgaaaggaaacaaaaggaaaggccaccaatgataagtattatgtaaatatggcaggtatcacagcctaataaaattaaaagactccacaaatttttgaaaaaacagaagtagctgtgtgacctgggacaagttatttaacttcaaatattattcattgggatttaatcatggtctacttctggggtccacaaaactttttctctataaagggccagactgtaagtattttaggtcttacaggtcatatggtctctgtcccaactactcaactcttcctttgcagaatgaaagaagctataaacaaaaatttatcctcacatcacctgcctttacacataaaaaatgaagtctagaaaaaaattaactgatggaaatttagatttgactaggtattaatgtgtgataataataataaattaaccatgctctcagtggaaatgagaaaagcaagtcatctcagaatccatcaaatttgttcatgctattaaaaacttagaataccaccttttcaacctgtactaaacaagaaactaataaaatactgaaagttcttccagttagaatttaaaggtcacaagggagaatcactccactatattaaaaagacaaagctaaactataaaatccaaattttaaaactcatcggagagctgagaatacaaagaagtctgaaaaaaacaacaacaacaacaaaaaacaattccagaaaggaaaaagccctttctaggctaacagacaagtgactactttcaactctgagatcatggtgaacacaggaatgaataatcctatagactgatacgatggaccaaattccaaagaagtcccacaagtaaagttaatcaaaacaacctaaaaattcttccccatggagctttaatagagtatacatcaatgtgcactaatctaggggtagactcggagggcaaagtgagatgatctgcagagtagaaagtcaagtgcagtgctaaagcagagagatccccggaacttagctaaacttaaatctcaagatctattgtagagtgaagactgaatcctcccttaaaacacttgaaaccaaaaataactacagttgcagctcagcccagacataactcaattccatgtcagaattaatagtttagtcccttttttgatctgtctgaggaattagcatgtcttttctcaggaagaagcagttagaaatttcattttcactgcctttttttttttttttttttttttttttcttgagacagagttttgctcttgttgcccaggctggagtgcaatggcacgatctcagctcactgtaacctccacctcccaggttcaagcaattctcctgcctcagcctaccaagcagctgggattataggtatgcgccaccacgcccagctaattttgtatttttttagtagagacagggtttcaccatgttggtcaggttggtctcaaactcctgacctcaagtgatccacccgcctcggcttcccaaagtgctgggattacaggcatgagctaccacgctcagccttcactgctctttttacatttaatattcacatataataaaaattacaggatagtcagtcatgaaaatgtgacttataggcaagagaaaaaagtcaacactaacccacggatgatgcagattggaatgagcaaagactttaaaataaattttataaaaatatatgatattattatgtataatcttatagagagaaaaaacattgattaaatatattttgtcacagaagaagaaatttgggggaaaaagagccaaatggaaattctcaagtaaaaaatatttgaaaagttcactaaatagacttaataacagatgagacacagaaaagatccatgaattcagagaggtcaacacaaactatccaaattaaaacgaagaaagccaggcacagtgattcacgcctgtaattccagcacttcaggaggccaagacaagaggactgcttgagtccaggagttcaagaccagcctgggcaacatagcaagaccccatctctacaaaaaaaatttataataaaaataataataaagtaagaaatactaaagtaatttcttcagactgaaggaaaataatctcagacagaagtctagatctgcaagaaggaatgaagagtactagaaaatattgtgaacaagacagctatgtctactgttaccacttctgttcaacactgtaccagtggtaacagcaagtgccataaagcaataaaaagaactgaaggcatgaagactggaggaagaattaaaactatctttatgggccaggcgtggtggctcatgtctgtaatcccagcactttgcgaggctaaggtgggcagatcacttgaggtcaggagtttgagaccagcctggccaacatggcaaaaccccatctctactaaaaataccaaaaattatccaggcatggtgccatgtgcctgtaataccagctactagggaggttgaggcaggagaatcgcttaaacctgggaggaagaggttgcagtgagctgagatcatgccactgcactccagcctgggcgacagagtgagactctgtctcaaaaaaaaaaaaaaaaaccttattagtctcagataatgagactttatatatggaggatccaaagaaatagacaaactagtaaaactaataattgaatttggcaagttcaaaagatacaaggtcaatctacacaaatcaaatatatttctaaatactccatgaaagaatggaaaatgacatttttaaataccatttataatatactcaaaaaacaaacacttagcaataaaattaaccagaatatgtgaaagatctctaacgtgaaaactatgaaactttgctaaaagaaattaaaatctcaatgaatgtagatataccatgttcaagaagaggaagactcagtattactaagatgtgaatttcccaaaactcatctatagattcaacacaatctcaatcaaaatcccagcaaagttactttgtgaatattgacaaacttatatcgtttatatggaaaagtaaaagaccaagaatagccaatacaatattgaaggagaaaaacaaggtcagacactacaagatttcaaatttactataaaactacagtaaatcaagactggcaaaacaatacacaaacagatcaatgaaacagaaaagagagtccagaaacagacccacacaaatatagtcacctgatctttgacaatgaaacaaaggcaagtcaatggaaaaaggatagtcttttcaacaaatggtgctggaaaaactagacaactacatccaaaaaaaaaaaaatctcaacacagaccttacacgtttcaccaaaaattaactcaaaatggatcgcatatctgagtgtaccacacaaaactattaaactcctataagacagcatgggggaaaatcttggtaaacttaggcttggtgatgacagtataagagaaaatcttgctaatctcagccttggcaatgacgttttagatacaacaccaaaagcacaaaccatagaagaaataattgataagctggacttcattaaaaataaaaacttctgctctgcaaaaggcaccgttaagagaatgaaaagacaagccacagactgacagaaaatctttgcaaaacacatatatgataaaggactagtattcaaaatataccttaaagatgccgggcgccatggctcacatctgtaatcctagcacttggggaggcagatgtgggtggatcatttgaggtcaggagtttaagacaagcctggccaacaggctgaaactccatctctactaaaaatacaaaaattagccaggtgtggtggtgcatgcctataattctagctactcaggaggctgaggcaagagaatcacttgaaccggggtgacggcagggtggtggcagggtggcggggggcggcgcgggcagaggttgcagtgagccaagatcatgccattgcactccagcctgggcaacagagtgagactctgtctcaaagaaaaaaaaaaaaaaaaaaaatatatatatatatatatatatatatataaacacataaacacacacacctccaataactcttaaaacacaataataaggaaatgaataacccaattaatatgggccaagtgggaaatctaaacagacatcccaccaaagaagatatacagacaacaaataactaaatgaagatactcaaaatcatatttgttagggaactgaaaatcaaaaccatggtgagatagtactatatgcctattagaatggcaaaattctgaaacaatgacaaaaccaaatgctagtaagaatgtggaattacaggaactctcattcattgctggtggggatgcaaaatagtacaaccacttttcaagacagtttggcagttcttacaaaactaaacatacttttgccatataatctaccaaccatgctcactggtatttacccaaatgagctaaaaattcacttcactacagggcttgccagggtggctcatgcctgtaatcctagcactttggaaggctgaggtgggaggaacgcttgagcctaggagttcaagaccagcctgggcaatgtggtgtgacctccttctctacaaaaaataaaattagccaggcatggtggtacatgcctgtggtcctagctactcaggaggctgaagtgagaggatcccttgaaccagaaagatagaggctagagtgagcccagatcataccactgcactccagcctgtgggaccctgtctcaaaaggcaaaacaaacaaaaattacctccacccaaaaacctgcagacagaaatcagacacagtggcacatggcaacagtcctcactattcaagaggctgaggtgggagaattgcttgagcccaggagtttggggccagcctgggcaatatggtgagaaactgttgctaaaaataaaaaaataactttaaaaacctgcacatggatgtttacggtagctttatttatgattgtcagaaattgaaagccaccaagatgtccttcaaaaggtgaataaacaaaccctagtatccatacaatagaatatatttcagcaataaagacaaacgagctatcgaaccatgaaaaaatacagaggaatcttaaatatacattgctaagtaaatccaaaaagcctatgtactgtatgattccaactacatgacattctggaaaaggcaaaactatggcgacagcaagaagacagtggttgaaaagcgttgtgggaggtgaaaggatgaaaaggtaaaagcatgagatttttaaggcagtgaaactattctctatgatactgtaacggtacagacatgtcattatacatctgtcaaaacccacaggatgtaggacacagagagtgaaccctaaactacagaccacaaatagtaacgatggattaatatggctcatcaactgtaacaaatggacctcacttaaccaagatgctaaacaataggggaaactgtgggggcaggaggaggagcaaggtgatatccggaaactccgtattttctgctgcatttcactgtaaacctaaaactgctttaaaaaatagaccctattaaaaataaaagaaaatttaaaattttaaaaataaagtatattaattaaaataatttttagttgcttacaaagtcatcaacctgcatactataaaattttggcattttattgtaaattaaaacttaattttttaaaatgtaatactcaacagtctcttaggccttctatctgaagatgaatatcgaaaaaaggatacagtataatatgcatgtgttttaaaaatgcaaggtgacatatggtctacaagtgcatatgcatatatataagtaaatgcacaaataaatatatgaaaacacatataccaaactggaaagagcaccactaggaaacgaacactatggaaaaccaacactactgtgaagggaatgaaaggaaaagatgggggatgtggagtgtgtcctaatccatatgtcttgatctctcttaagaggatctacattaatgtttccaattcgctattattaggttttatactacatttaaaatgtaggcttcagaatctgaagaggaatttcaaaatgttttataaatctttaagactaaacagcctcagcataaactaacattggagacagatttttacctgtaagtatttctgcacctgtatttaaaagtataaaaaagtatttaaaagtttaaaaaagcatttttacctgtaagtatttaaaaggaattttaaatcactcaatagtgattgatcaggcaaggaacaagtattatctgctgattcttagtttgtctgtaatgccatccctacaaagactgtatttccattgcaccctccttttattactcggctgattataccctaaaacacatacacactcctccctggtgtagatgctgacagcttaattcacattatataattcatataatagtgaagttgtaatacagaatgcaacagtatccattatatcagaataaggaagaaaactggtctgagatgtgctattatgatataaaatcaactaacaacgtaccaatcaataaactaaccatgcttctcttttttttttttttttttggtaaatgtgggtattttaattttccttgataaggacaaatatggccatgagaagtttctctgggagtttcatcatctgccatttacagagagtgggaagttatgcagcaattagcctaggagagaagtgtccaccaacctatgaagacagtctccacagctcaaggagacagtaagagccagaaagcgttaataccagtcaccccaaaaatgcaaagatcctcccagtaagctacttaaaaaatgtaaaaagtgaggtctaaattgtgaaattatactttttgggttttttttttacttttaagttcaagggtacatgtgcaggtttcttataaaggttaactcacatcacaggggtctgccgtacagattatttcatcacccaggtattaagcctagtacccattggttatttttcctgattctctctctgctcccaccctccacctcatcaattagcttccacttatgagtaagaacatgtggtatttggttttctgttcccatattagtttactatgaataatggcctccagcttcatccatgttcctgcaaagaaaatgatcttgttctttttgatggctacacagtattccatggtgtatatatacaccacattttctttaccggtctaccactgatgggcatttaggttgattccacgtccttgttatcataaatagtgctgcagtgaacaaacacacatgtgtacatgtctttaggatagaatgatttatattactttgggtatacacccagtaatgagattgctgggttgaatggtagttctttttaggtcactgaggaatcaccacactgctctctacaatggttgaactaatttacactcccaccaactctgtatatgtgttcctttttctctgcaaccccgctagcatctgttatttttgactttttaataatagtcattctgactggtgcgaggtggcatctcattgtggtctgattcacatttctctaattatcagtgatgttgagtgtttttccacatgcttgttggccacaggtatgtcttcatttgaaaagtgtgtgttcatgtcctttacccactttttagcgggttttcttcttgtaaatttaaattctttataggtgctagatattagatctttgtcagatgcagtttccaaaacttttcttccattctgtagactgtttactctgttaatagtttcttttgctgtgcagaagctctttagtcactctaagctctttgtcaatttttgcttttgcaattgcttttggtgtcttcgtcataaaatctttgcccattcctgagtccagaatggtagtgcctaggttgtcttccatggtttttacagttttaggttttaaattagagactttaatccatcttgagttaatttttgtacacggtgaaaggaaggcatcgtttcaatcttcttcatacagctagccagttatcccagcaccatttattgaggagggagtcctttgcccattgcttgtttttgtcagctttgttgaaggtcagatggttgtaggtgtgccttatttctgagctctccattccattggtctatatgtctatttttgtcccagtaccatgctgttttgtttccggtagccctttgtagtacagtttgaagtctggtagatgcctccaactttgttgtttttgcttaggattgccttgactatttgggctcttttttggttccatatcaatttttaaatatttttttctagatctatgaagaatgtcattggtagtttgataggaatagcactgaatcgataaactgctttgtgtagtatggccattttaacaaactgattcttcctatgaatgtggaatgtttttctattagtttgtgtcatctctgatttctttcagcagtgttttctagttctccttgtagatatctttcccctccctggttagctgtattcctaggtattttattccttttgtgatgattgtgaatgggatttgtgttcctaatttggttcttggcttcttgactgttggtgtattggaatgctagtgatttctgtatgttggttttatatcccgagactttgctgatgtcatcagcttaagcagcttttgggctgagattatgaggttttctaaatatagtcatgtcatctgccaaggacatggacagggacatggacagggatagtttgacttcctctcttcctatttaaatgccctttatttctttcccttgcctgattcctctggccaggacttccaatactatgttgaattaggcagtgatggagggcattcttgtcttgtgccagattaagacaaatgtttccagttttggcccatgcagtatgatgttggctgtgggtctgtcttattattttgaggtatattccttcaatacctcgtttattgagagtttttaacacgaaaggctgttgaattttatcaaaattcttttctgcatctattgatataatcatgtggtttttttagttgtttatgtgacgaatcacatttactgatttgcatatgttgaaccaaccttgtatcccagtgataaaagcctactagatcatggtgggtaagttttttgacatgctgctgaatttggtttgccagtatcctgttgaggatttttgcattgatattcatcaagcatgctggcctgcaattttttttgttgtgtctctgctaggttttgatatcaggatgatactggcctcacagaatgagttaaggaggggtccctcctcctcaatttttgggaatagtttcagtaggaatagtaccagctcttctttgtatatctggtagaatttggctttgaatccatctggtcctgggcttttttgctcgatgggctatttattactgattcaacttcaaaactcattactgacctgttcagagatccaatttcttcctggttgagtcttaggaaggtgtacgtatctaggaatttatacatttcttctagattttctagtttctgtacacagaggtgttcataacagtctgatgattattcctatttctgtgaggtcagtggtaatagcccttttgttgtttctaattgtgtttatttggaccttctccattttcttattagtttagcaagcaatctattaattttttcaaaaaaccaaatcctaaattcactgatgttttgaatggtttttcgtgtctcaatctcctgccattcagctttgattttggttatttcttgtatgctgcaagtttgggggttggtttgctcttggttttctagttcttttagttgtgatattaggttgttaaattgagatctttttaactttttcatgtgcacacttagtgctgtaagttttcctctttacactgcattagctgtgttccagagattctggtatattttatctttggtctcattagtttcaaagaacttggtttttgccttaatttcatggtttacccaaaagtcagaagaaggttgtttaatttccatgtaattgtatggttttgagcaattttcttagatgtgacttctaattttattgcactgtggcccaagagagtggttgttacgacttcagttcttttgcatttgcagagaaacatgtcgaattgtgtggtcaatttcagagtatgtgccatgtggtgatgagaagaatgtatattctgttgttttggggtagagagttctgtagatgtctattaggtccatctgatccagtgctgagttcaggtcctgaatatctgttaattttctgccttgatgatctttctaatactgtcagtggggtgttaagctctcccactattatggtgtagaagtctacatctctttgaaggtctctgagaacttgctttatgaatctgggcgctcctgtgttgggtgcatatatatttaggatagttaattctcttgttgaaatgaaccctttaccatcatgtaatgcccttctttgtccttcttcatctttgttggtttaaattgttttgtttgaaatttggattgcaacccttgcttttttgttttccatttatttgcttggtaatttttctccatccctctattttgagcccatgggtgtcactgcataggagatgcactacacaccttagtttttttatccaatttctcactctgtgccttttaattggagcatttagcctgtttacgttcaaggttagtattgataagtgtggatttgatactgacatcatgatgttacctggttgttatgcagacttgtgtggctgctttatagtgtcactggtctgagtacttcagtgtgtttgtgtagtggctgctaacagtctttccatacttagtgcttccttcaggagctcttgtaagacacgtctgacggtatcaaattccctcagcaattacatgtttgaaaaggatcttatttcccctttgctatgaagcttagtttggctggataagaaattcttggttggaatttttctttaagaatcttgaatattcactcccagcctcttctggcttgtagagtttctgctgagaggtccaccattagtctgatgggcttccctttgtagttctcatgaatgagatcctgaaatatattttccaagttgcttccattctccccaactctttcagggacaccaatgagtcgggtgtcatagatttggtctctacataatcccgtatttcttggaggttttgtttgttcatcttcattcttttatccatattcctgcctgattgactgtcttatttcagaaagccagtcttcaagctctgagattctgtcctcagcttgacctattctgctattaatacctgcagctggccgggcgtggtggctcacgcctgtagtcccagcactttgggaggccaaggtgggtgaatcatgaagtcaagagatcgagaccagcctggccaacatggtaaagccccgtctctactaaaaatacaaaaattagctgggtgtggtggcacaggcctgtagcccccgcttttcgggaagctgaggcaggagaatcgtttcaacccaggaggcaaatgttgcagtgagccaagattgagccactgcactccagcctggcgacagagtgagagagtctgtctcaaaaaaaaaaaaaagaaaaaatgaaaaaatctgcagctgcattatggaattcttggagcatgtttttcagctcattcgggttggttacattcttttctataatggctatttcatctgtcagctcctgtattattttattgtgattcttagcttccttggattgggtttcagtgcactcctgcatctctatgatcttcgttcctatccattgtctgaattctatttctgtcacttcacccatctcagcctagttcagaaaccttgctggaaagccagtgtggttgtctggagaaaagaaggcactctggctttttaagttatcaggattcttacgctggttctttctcaactttgcgggctgatgttccttcaatctttgaagatgctgtccttcgaaatggttttttgtttttttcctttcaccctatttgatgaccttgagggtttgattgtggtatataaggtgggttcagtcaactggcttcatttctggaagattttaggtggccaaggttcagctcctaactcccagattacatgctctaaatctgggggactggtattgggaccctattttgttctctggctcctcaatgttaggaacccactgcactgggggtaggagggtgtcaaggtgcccctggactacttgtcactacactccagcgggtggtgccaaagagttttgtaaggcagtggcagtgggatctaccctcattcccatgtgccagtggcagcacagaggggtgcacacttgtcagctgtggcagtgtgctagcagatgccagagtgtcagcctcagtgtgggcgtttgtagcagtggtacaggcagcatggcttaagcgggccccactggcaactatgcatgtggtcacactggtggtggtgttagccgggtagtgctggtaagggcaaatctgtgtgcaccctctgtgcacatttacacaggtggggatggccactcagggagggggagggttcattgttctctgtgcctagtttcactccagcagcaatgttggcaagggggtggggcactggcggggtggggcactggcagggcagggctgaaaggctctgtgcctgccaagactctgactgcaattacagtacaaccaggggaagggaggcagagtgcactcacactggcagcagtggcacagggtaatgtgcacgtgcacacgtgctggcgaggcgagggaaagcaagatctgcctgtgcacacacaccggcaaagtgatgtgtgttgggggggccggggcagtggtctgtgggcagggaggggttggggtgtaagctgcaataggggaagggagcaggcaggcaggctggtgcatatccaccggggctgttttgttttttttgttgtttttgttgttgttgttttttttgagacagagtttcactcttgttgcccaggctggagtgcaatggtgcaatctcagctcaccacaacctccgcctcccaggttcaagcgattctcctgcctcagcctcccaagtagctggggttacaggcatgcaccacacacccagctaattttgtatttttagtacagacgggatttcttcatgttggtcaggttggtgtcaaactcccgacctcaggtgatccacctgcctcggcctcccaaagtgttgggattacaggcatgagccaccgccccggcccacaggagctattctactgcagctctctgccattcaagtgtggtcaggtcagccagcccaggagctatgatgcaggtccccagggtacccaaggcttcactgcaagcaggcgcaaccaggctgggtccccagaagaggccagcagaccaaagcatgctcaggttgatgggcaagactgccctgcagagttcaggtctgactttctctagggctaaagtctcctatgggagcaagtcaagcctagggagatgggcatccctggccatgctccactatagacactcctgcaccaaaccctctgggctctgcactgactggagtgctgcctctaccacttttcaagtgtgcttgagaatcaagcagctctccctgccaactcgagtgtccatgaagtttgagggatctcctcctgccaggattccagaggcctgtggtgagagcataccgttccttgccagttcaactcacccgtttccctggagtcactgggcaccaggaacaagtcctggtgcatagtagccttgtgcagggttcccaggttcctcccacttcatcccaacatctgtgtcttccctctgtctactctcagtgccttccctctgaagatctgttaggagtgtgccagttgtcccagtccctcagtggcagccattccacctggctgtgtctagtcagccatcttgcccaccttcctcctttctttctcatattttttttccactatgcctttctccagagaaaatttaccttctattcttttctgctgtttgggtttatactactgtcgttatgtactgaactgtgctgttctcccaaaatttgtatgttaaagccccaatctgcaatgtgagtgtatttggagacaggacctttaaagaagtaatgaaggttaaatgaggtcataaggaaaggtcctacttcaataggatgggtgtccttgtaagaagagatgtcagggatgtgtgcactacaaaaaaaggtcatggaaggatacggcaaacagcagctaccagcaagccaaaaaaagaggctccaggagaaactaaacctgacaacaccttgatcttggacttctagtcaccaggagtgtaggaaaataaatttttgttttttaagccactcaatctgtggtattttgttatggcagccccagcaaattaatacaactgtacagcagtctttggcacacaattattaatatgttcaacttgatactgttttataataaactctatagaatactaactagttttctgtcattgcccaaaaagtgcaatgccctctgggcctactgtcataggtcaatgccttctgtgcctactttgcctttctttttccaatagtgcttcaaatattctatagagttcctttctcttccatctcctctactgtgatcatctctgatctctgctcttagtatttaccattgtcagaggtctactttccaacacattatcaaatttataatctaacacatttgccacttactactgtgacatatacaccctcacctcccttgactcactcctttagcagctgcttcatgtatacttctcagccttgctaatactgacattaggcatttagaaccaacaaccaaaaagagctctaccagtcagtaaaaaatatatatatgtatatgctagtttctgctgattatcttattgctcttaccagtagtattttgttctgactgacagagacgttccctgagtttggaaaactcaaatgttactccagaacttaaaaaaactgctcttcaaatactatctaaatacagtccagctaacccaccatcaacaaaatatatgccagggttgatttttctacttacatgtatgtctatgctcatttatccacagtcatccagtctcccttctctggtcaatgatgtacacttttgcagaataaaacattccaaaggcaagagtatgatcagaaaacagagtatcccttatgaactcaatcaagaataaattctgaaatcttgttctccctggaatgggacactgcacaactaagttaacacttcaaaatactcatcaaatgttgtcttattacctcaagagtcaaaacaatgtagaaaaataatggtttttgtttttgtttttgttttgagacagggtctcactctgttacccagactacagtgcaatgtcttgatcacagctcaccacagcctcaacctcctgggctcaagcaatccttccacctcagccaccccaatagctaggactataggcacacagcaccacacctggctaattttttaatttttttgtagagacagtttcactatgttgcccaggctggtcttgaactcctgagctcaagtgatcctcccacctcagcctcccaaagtgctaggactgcaggcatcagccactgtgcccggcaggatgggtcatttttattccttcaagaaccgtatgagctgggccacagaggctcacacctataatcccagcactctgggaaaggaagggaggaggatcacttgaggccaggagttcgagaccagtctgggcaacatagtgagacttcgtctctacaaaaaattttaaaaattagctgggtgtggtgacatactgctgtggtcccagttactcaggaggctgaggtgagaggaaagctcgagccccaaaagtaaaggctacagtgagccatgatctcactactgcactctagcttggacaacagtgtgagaccctcctcaaaaacaaaagcaaaaaaaacaccaacttatcaacagcaatgttgtcataccacttactaaaaagttcaaacttaaaagtttctctgggttttggtcctttttaagaggtgtcatattcattctgtatcaaaaactgtattgtgccaatggcttcgagtgggatattaaacaatctcacctctattttgttaagctgtgagataacaatgctatattaataacttattaagactaagtatacaggaattgaaattacttttatgtaaaataaaagtgcaagttaatcactatgtactgcatggtcattagaattagataggtagcaagtcataaattactacttattagcccactggtaaaattacagctgttctgaagttttagagaaatcctaaatattcaagttttccaatgaactggaatttcagctctttaagcttctctaagctttagaagttcttcttttaatactctggattaattatttctataatatactaactttatatctttttaaacaaagtatattaaatataccatgcatttcttaaaaatttagaattgcataacaaatgttaattttgatatgatacagttaatatttattagaaactactgatataaacaaggttggctgtccctgtcaatattcccagattgctttatagacaagtgcttcatcctatcagcctaacaacctataaatgtccctgttctcatttactgtttctatactacgtaaccttagaaaccaaattcttacttaaattacctgaaataaaactagcccctaaataaaagcctaggggactctcatataagtatagaaatgttaaacatattttcataatctccattaaccatttaaagactctggggttttttgcaatataatctgaaaataaacatgggctttgtagtcagtcacacagtgaggggttcagatcctaccattacacttactagctgtgaaatcttggaaagataataaaccaccttccctaaatgtttatattcttttttaaaaaaactccatcacctagttcatcattgctgtgagattaagtgtgatactgtatataaataaacaatgattgggtgctgggcgcagtggctcacacctgtaatcccagcactttgggaggctgaggtgggaaaaccacttgagcccacgagttcaagaacagcttcagcaaaaaaaaaataaataaataaaaaataaaaaaataaaaaagcaacacctcatctccacaaaaaaaatttaaaaatctacccaggcatggtggctcatacctgtagtcctagctacttggcaggctgaggcaggaggatcactggaccccaggagttcaaggctgcagtaagctatgacttcaccactgcaccacagcctgcataacagagtaagatctgtctcaaaaaaaaaaaaaagtcaactttcatacctattttaatcattgatacaaatagttaatataacaaatttactgaattttacaaacaaaattcaccatttctttttcgtttttatttcttgatatccatatggggtgttagctttctataccaaatagcttttaaccactttattcttttcttgtttttcttttctttcttttcttgtcctctgtgactgagacatttccacatggctaaaacagtagaaatccttaagactacagtcatatatgggaaagaatacgcaagcctaactgctcacactcctagatcataaataagcttctgaaagtcaaactctgctatttactagtaatacaactttacctgaactactctctctctctgagccttaatttcttcatattcaaaaaagaatggagatatccatctccaataacatggccaattacacagaacacaactacaactaagatttttaaaactaaatacatcagaaaatatatattctttttttcttttttttttttttgagacagagtttcactctcttgcccaggatggagtgcagtggcgcgatctcggctcactgcaagctccgcctcccaggttcacaccattctccctgcctcagcctcccgagtagctgggactacaggtgcccgccaccacgcccagctaattttttgtatttttttagtagagacggggtttcactgtgttagccacgatgatctcgatctcctgaccttgtgatccacccaccttggcctcccaaagtgctgggattacaggtgttagccatcgcgcccggcgaaaaatatatattcttaaaagcctcaaagagctaatgttaaagaattataagcccaaaacataagatagggcaggaattcagagagataagcagagcactgaagccaggttagctactgacagaagccaaactcaggctttggttttcatagtctcataatgatagaagccaagcccatgacccagccttagtggtgagtctgataagacacccctataccatatggctggaaccagtaaaatgaacaaaagtaaacctgtcctattctaacctaatcccctaagaacttcaaagaaagctgctttggcactgagcagaaaagaatgatgggagaaaggagagttcctgacaagttattaacaggaaacagcaaactttttctgtaaagggccagaggtataaatattttaggccttagctgagtgtggtgcctgcctgtagtcccagctactccggaggctgaggcagcaggatcccttgagcccaggggtttaagactgcagtaagctatgacttcaccactgcacgaccactgcccaccatcctgggcaacagagggagactgtctctaaaaaataaataaataaataaatattttaggctttgaaggcaatatgatctctgttgtaaccaatcagctctgctgttgtagcatgaaaacagccacagacaatacataaaccagtgagcatggatgtattcaataaagatttataggcacttaagtttgaatttcatatgattttcatgtcacaaattatttttttccaaccatttaaaaatgtaaaaaaaactctactagcttgcagcccaaacaaaacaggtggcacaagccagtttccatttacttgtaacaacaagacacacaccaccacttcagccaccaccttacttacacacacacacacacacacacacacacacacagagatttgaggctctaattcccatcacctagatgaagtaaaaaacatcaggccataaacatttagaaaatacatgtgcaaaacccaccaagtactgtcccaggaaaaattaacaagaaaaaaagcaccacaaatgaaaagcaagcaagcaaagaataccaacacacatgcaaaaatttcagatattagaaaagatcacatagagaatataaaataactgctttctaaagtttaaagcaacaaacaagcttgaaagggtcgtatatatgagaggggaaagaatcattaaaaaatgacttagcaagctaggtgtggtggctcatgcctgtaatttcagcactttgggaggttatggtgggctgatcacttgagcccaggagttcaacaccagcctgggcaacatagtgagaccctgtctctacaaaaaataaaataaaataaaaaatagctgggtgtggtggcctgcacctatcgtccctgctactcaagaggctgaggcaagaggatcacctgagcccaagggaaagaggctgcagtgagccgagatcacaccactgcactccgccctgggcaacagagaaaaaatgacttagcaaatataaagaattaaaataatttctaaaattgtaaaacacaaggaactgaaattaaaaatcaaatcaggccaggcacagtggctcaagcctgtaatcccaacattttgggaggctgagatgggtggatcacttgaggttaggagttcaagaccagcctggccaacttggtgaaaccccgtctctactaaaaatagaaaaattagctgggcatgacagcaggcacctctaatcccagctacttgggaggctaaggcacaagaaccacttgaagccaggaggcggaggttgcagtgagccgagactgtgccactgcactccagcctgggcaacagagtgagactccatctcaaaaaaattaaataaaaaaaaccacacaaataaaaaataaaataaaatcattgaaaagtagtgaacttaaaacatacatctgaagaaatcacccacagtaaaagaagaaaaatacacacccaaaaaaagaagaaaaacacaaaaatacaaaaaaaggttaaaaaaacatataagaaagccagacacggtggctcgtagctataatcccaggaacttgagaggctgaggtgggaggatcacttcagcccaggagttcaaggctgcagtgagctatgatcacaccactgcactccagctgggaaacagagcaagaacttgtcaaaagaagaaagaagaaagaggaaggaggaagaagaaagaaggaagaggaggaggaggaggaggaataaaagaaaaaatacataagagtaagaaaatctaacatatatagacatacctcattttatcgcactttgctttattgcacttcacagatagtgattttttaacaaattaaaggtttgtggcaaccctgtgtcaagtaagtcaacaggtgccatcttctaacagcatgtgctcacttcgtgtctctgtgtcaaattttggtaattcttgcagtatttcaagcttttttaaacttttttatgtatttatttatttttagagacaggatctcgctctgtcacccaggttgcagtgcagcagcatgaccatcatagctcactgcagcctcatattcctgtgctccagcaatcctcctgcctcagcctcccaagtagctagcactacaagtgcatgccaccctgcccagcttattttttaagtttttgtacagatgaggtcttgttatgttgctgagtctagtctcaaactcctggccttaaagcaaacctctcacctcagccttctaaagcacctgtattacaggtgtaagccgccacacctagcttcaaacttttttattattatatctgttatggtgatctgtgatcagtgatctttgatgttactgtaattgttctgaggcaccaaaaatcatgaccatataagacagtgaacttaatcaatcaatgttatgtgtgttctgactgctccatcgaccagctgttccctgactctttcttctcgttgggcctcactattgcctgaaacacacaatattgaaattaggccaattaataaccctacaatggcctctcagtattcaaatgaaaggaagagtcaaatgtctctcactttaaatcaaaacctagaatgattaggcttagtgagaaaggcatgctgaaaacctagacaggccaaaagctagacctcttgtgcaaaacagtttgccaagttgtgaatgcaaaggaaaacttgaaggaaattaaaagtgctactccagcgaacacacaaataagatagcaaaaccaccttactactgatatggagaaagttttagtggtctggaaagaagatcaaattagccacaacattcccttatgccaaagcctaatctggagcaagtctctacctctcttcacttctatgaaggctgagagaggtgagaaagttatagaagaaaagttggacactagcagtgttgatgcatgagatttaaggaaagaagccgcctccacaacataaaagtgcaaggtaaagcagcaagtggtggcatagtagctggagcaagttatccagaagatccagctaagataattgatgaaggtggctacactaaacaacagatttttaatgtgacaaaacggccttgtgttggaaaaatatgtcatctaggactttcataattagaagtgaatgcctggcttcaaagcctcaaagaacaggctgcctctcctgctaggggctaaggcagctaatgactaagctgaaaccaatgctcattgaccattctgaaaatcctagggctcttgagaattaacgctaaatcaaggccagatgtggtggctcacgcctgtaatcccagcactttgggaggctgaggcaagcggatcatctgaggtcaggagttcaagaccagcctggccaacatggtgaaacctcgtctttataaaaaatacaaaaattaaggtgggtagatcacctgaggtcaagagtttgagaccaacctggccaacttggaaaaaccccatctctactaaaaatattagctgggcatggtggtgggagcctgtaatcccagctacttgagaggctaaggcaggagaatcatttgaacccaggaggcagaggttgcagtgagccaagatcacgccactatactctccagcctgagtgacagagcgagactgtctcaaaaaaaaaaaaaaaagaaaaaaaaaaattagctgggcatggtggtgcaggcctgtagtcccagatactcaggaggttgaggtgggagaatcacctgaacccaggaggcagaggctgtagttagttgagatcacaccaccgcactccggcctgggcaacagtgagatcctgtctcagggaacaacaacaacaaaattacactaaatctactttgcctttgctctctaaatggaaaaacaaagcctgaatgacaacacatctgttgacagtaaggtttactgaatgttttaagcccaccgttgagacctactgctcagaaaaataagattccttcaaaatactactgcttattgacaatgcacctagttacccaagggctctgttaaagatgtacaaggagattaatgttttcccacctgctaacacaacatccactctgcagcccatggatcaaggagtaattttaactttcaagtcttattatttaaaatatttcatgaggctttagctgccatagacagtgattccccttatggatctgggcaaggtaaacgtaaaaccttctgtaaagaattcacctttctgggtgccattaagaacattcatgactcgtgggaagaggtcaacataacattaacaggagtttggaagaggttgttcccaagcctcatggatgactttgatggcttcaagacttcagtggaagaaggaattgcagatgtggtggaaacaaagataattagaatttaaaatggagcctaaagatatgactgaactgcagcaatctcacaataaaacatgaacagatgataagctgcttcttactgatgaccaaagaaagtggtttcttgagatagaatctactccttgagaagatgctgagaacactgttgaaatgacaacgaagtatgtataatattacatcaacatagttgataaagcagctgcagggtttgagaagactgactccaattttgaaaaaagttatattgtgcataaaatgctatcaaatggcactgcatgctacagacaaatctttcattaaaggaacagtccactgatgcagcatacgtcattgtcttatttcaagaaattgccacatccactccaactttcagcatccactatcctgattagtctgcagccaccaccatgaagtaaagaacctccaccagcaaaaagattacaattcaatgaaggctcagatgaccgatgaccgttagcatttttttaatattttctaatcaatgtgtggatatttttgtagacatggtgctattatacactttaaatagactatagtacagtataaacataagtcttatacgcaatgggaaaacaaaagtttcatgtgacttgctctactgcaatattcactttattacaatatttgctttattgcagtggtctgaaactgaacttaaatatatcagaagtatgcctgtatataaactggagatccagaaaaagaaagactgagatggtgaaacaaaaatatttaaaaactgggaggccaaggtgggcggatcatgaggtcaagagatcaagaccatcctggccaacatggtgtaaccccatgtctctactaaaaatacaaaaatgagctgggcatggtggcgtgcgcctgtagtctcagctactcaggaggctgaggcaggagaatcgcttgaacccaggagacagaggttgcggtgagccgagatcacaccacttcactccagcctggtgacagagcgagactccatctcaaaaataaataaataaaataaaaatttttttaaaaaaaagaagaaacagaaaaagaaagaccactgaaactataagatcatttcctctgaaaacaattaactagaaatcagtataaaaaagatgagtgggcataacaaatgtatttttcaaagatgtccacaccagcatataccccatcccacacatacttttacaatgtgacttgacacttttccctatgcttcctcctcctcaaacatgaatggagctctgtaactctggatcaccagaatgcagaaacaaggctaggtcataaatggcaacatggcttctatctggtatgctctctctctcaggaattccactgaccatgccctgacaacagttaaagtttcatggaaaaacccacatggaagggaactaacacagaaatgccaagtttaaccactcctgaattcctaacccaccaaaactgtaaaggataataagccactaagttttgggcttaactggttatgcaacaatagataactaacatactaaaaattgtcacttatttggaaatttttaaatatactcctaaataatatatgtgaccaataaatgaaaaatattttgaaataaataacaaaactacatttcaaaacttgtgagatgcaattaaagcaatacttcatgggaaaatgtataaccctaaataagtataataggaaaaaaaattagagagctatctattcagaagataaaaaagaattgcaaaataaacctgaagaaagtaggaaggaaataacagaagtgatcaggtgtgtgtggtgccacacacctatagccccagctagccagggggctgaggcaggagggttacttgagcccaggagttcgagaccagcctgggcaatataatgagaccacacccccatctcaaaaacaaaacaaaacaaaacaaaacaaactgctgtgatcatattttggttagaaaagaaatgataaaaacgaagaagtgataagtagagagaaaacaaaatagtaaaggccatcaaagccagaagttgtatttaaaaaaaaaaacaactataaattggcaaacctctggcaaaaataattaagaaattaaaaagaaaaagaggccagacacagtagctcacacctgtaattccaatactgggaagcggaggcagaaagatcatttgagcccagaagttcgagatcaaccctggcaacacagccaagacctcatctctacaaaaactcaaaaagtagccaggtccaggccaggggcagggcctcacacctgtaatccagcactttgggaggctgaggcagacagatcaactgaggccagaagttccagaccagtctggcctacatggtgaaacctcatctccactaaaaaatacaaaagtcagctaggtgtagtggtgcacacctgtggtctcagctactcaggaggctgagtcacaacaatcgcttgaacctgggaggcagaggttggcaatgagccgagatgctgggcaatagagcaagaccctgccccaaaaaaaaaaaaaaaaaaaagaaaaaaaaattagccaggtctagtgacacacacctgtagtcccagctactcaggatcctgaggtggtagaatcactcgagcctgggaggtcaagactgcagccagccgtggtcacatcactgcactccagcctaggcaacagcgagaccttgtctcaaaaaaagaaaaaaaaaccaaggctgggcgcggtggctcatgcctgtaatcccagaattttgggaggctgagcgggtggatcacctgaagccaggagtttgagaccaacctgaccaatatggtgaaaccctgactctactaaaaacataaaaattggtcgggcatggtggcatgcgcctgtagtcccagctactcaggaggctgagacaggagaactgcttgaacccaggaggctgaggctgcagtgagccgagatcgagccactgcactccagccctccagcctgggtgacagagcaagacttggtctcaaaaaaaaaaaaaaaaaaaaaaaagcaaaggatcaggaatggaaaaagggataaaaactaacatcagaaataacagattagggtaatcccagcactctgggaggtgaggcaggcggatcacctgaggtcaggagtttgagaccagcctgggcagtatagcaagaccccatctctaaaaaaatagaaaaattagacaggtgtggtggcttgcacctggaatcccaacactttggggtgccgaggcgggcggatcacctgacgtccggagttcaagaccagcctggccaacatggtgaaacctgtctctacaaaaaatagaaaaattagacaggtgtggtggctcacacctggaatcccagcactttgagaggccgaggcgtgcagatcactctgagctataacagatgtgaagactcagtgctcggtggtgcccaggctggagtgcagtggcgtggtctcggctcgctacaaccccgtctgggaagtgaggagcgtctctgcctggccacccatcgtctgggatgtggggagcccctctgcctggctgcccagtctgggaggtgaggagcgtctccgaccggccgccatcccatctaggaggtgaggagcgcctctttccggccgccatcacatctaggaagtgaggagcgtctctgcccggccgcccatcatctgagatgtggggagcacctctgccccgccgccccgtctgggatgtgaggagcacctctgccccgccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggccagccgccccgtccgggagggaggtggggggggtcagccccccgccggccagccgcccggtccgggagggaggtggggggggtcagccccccgcccggccagccgccgcgtcccggagggaggtgggggggtcagccccccgcctggccagccgccccgtccgggagggaggtaggcgggtcagccccccgcccggccagccgccccgtcagggagggaggtggggggttcagccccccgccaggccagccgccccgtccgggagggaggtcggggcatcagcctcccgcccggccagccgccccgtctgggaggtgaggggtgcctctgcctggccgcccctactgggaagtgaggagcccctctgcccggccagccgccccgtccgggagggaggtgggggggtcagccccccgcccggccagccgccccgtcagggagggaggtgggttcagccccccgccaggccagccgccccgtccgggagggaggtcggggcgtcagcctcccgcccggccagccgccccatctgggaggtgaggggcgcctctgcctggccgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccaggagggaggtgggggggtcaggccccgcccggccagccgccccgtctgggagggaggtggggggggtcagccccccgcccggccagccgccccgtctgggaggtgaggggcgcctctgcccggccgcccctactgggaagtgaggagcccctctgccaggccagccgccccgtccgggagggaggtggcggggtcagccccccgcccggccagccgccccgtccgggagggaggtgggggggtcagcccccgaccggccagcggccccgcccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaatactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaagaaataacagattaggtggttccatggtgtaatggtgagcactctggactctgaatccagaaataacagatatatcagaaagccaatcaatacaatcaaccacatctcaaaaaaatccaagaaaattcagtagttatacacgtctctaatggagtcttggcaaaagaaaaacagaagcttccttgattcgataaaaggtatctacaaagcctacaccatgcttaatgaggaaaggttgaacatttttcccttgagatgagaaacaagacaaagatggccctataaagtcctatcaacattatgctggagatctcaggcagcaaaggaaagcaggaaaaaaataaaaggtataaggattagaaacaagagacaaaattgtcattatttgcatatgacataattatatatataggaaatccagaagaatctacagataaattcaaattatatatggttttttttgttgttgtttctttgttttttgagatggaatctcactctgtcacccaggctggagtgcagtggtgcgatctctgttcactgaacctccactcccgggttcaagtgattctcctcggctgaggaaggagaatcacttgagcctggcaggcggaggttgcagtgagccaagattgcgccactgcactccagcctgggtggcagagtaagactaagtctcaagaaaaaaaaaaagcagcagcagaagcagaagcagcagcagaagcagcagcagcagaaggagaagcagaggcagcagcagaagcagcagcaagcagcagcagcagaagcagaagcagcagcaagcagcagcagcagaagcagaagcagcagcaagcagagacagaagcagcagcagaagcagaagcagcagcagcagaagcagcagcaagcagcaagcagcagcagaagcagcagcagcagaagcagaagcagcagcagaagaagaagcagcagcagaagcagaagcagcgcagaagcagaagcagtggcagcagaagcagcagaagcagtggaagcagaagcagcagaagcagtggaagcagaagcagcagaagcagtggaagcagaagcagcagaagcagtggaagcagaagaagcaacagaagaagcagaagaagaaacagaagaagcagaagtaacagaagaagcagcagcagaagcagaagaatttcacaaatactgaactaattttttagattacataatatacacatagtattattatatgcacatgaagttcaaaaacaaggaaaactatattgtttaaggatgtatagctaggacttaaaattatgaagcaaagcaaaaaacagtcacaaaggtcaggataataactacctccactgaggggggatatgttgacaaggatggtgaggttggagggaagcacttctggcttgttgacctgggcaatgacaacactaatattcactttattatttcccttaaactgaacattttatgccttctcttgtatacagatggtccacaacttatgacggttcaacttacagtttttcaactttagcacagtgcaaaatcgatatgcattcagtagaaaccatacttcaaattttgaatttttatcttttcccaggctagcaatatgcagtatgatactttctcataatgctgggcagcagcagaaagcagcagctctcacaagggtaaacaactgatcctcaatagtatatactgtgttgccagatgattctgtccaactgtaggctaatgtgttctgagcgcatttaaggaaggctaagctaagctattatatttggtaggttaggtgtaataaatgcattttcgacttatggtattttcaacttacaatgggtttatcaggatgtaaccccactgtaagtaaggaagcatcagtatatgaatgaaaaggaaaaataacaactgcatgtaactagtatggtaatttaatatacggtaatataagtctggtacctagtgtgcattttttaaaagctaccataattacaaaatgttctgtatcctccccagtgcctacacatcaggaagttggtcatggtagatgctcaaatattttgatcaataaatgaaacaacttccattctgattaaacgaagtaaaagacaatttagatctgaatgattccctaaaccaactgtcattctacaagcccagagactgaattctttatatcccaacagactattccctctgcctttagcattttcctgatctctttctcttcattcataggatacatctgttctgccctactatactgtaagaagctgtacattaaatgcttagaatcctatacataatctgagatttaagacaaaaaaagagaaagaagaaaggttaaagttaaggggaaatggtacataagatgtacataagagcagaattttcaggaaaacccagtgaagatacaatgtatccttacatgaaaacattcaagacatgggcttttttttagttctaatgattcaaggagtcaggaaacagtgaaataaagcaggaaacagtgaaataaagcaggcaaatcatctactgtcccttcagacctaggtaccataccaaaatatatctactgtttttttcctaaaattatctcaacaacaacaaaacagaacaaagatacctctgaaagctacaagactcttctggaaaaaatcagctccttctcagtcacttgggaaaaacacttttttctttttccttttttctcttttaagagacagggtcttgctctattgcccaggctgttggactactaccgtggcatgatcattatggctcagtgtaacctcgaactcctgggctcaagtgatcctcccatgtcagccttcccagtagctaggaccacaggcacacaccacaatgcttggctagttcttttgtttgttttggtagagacagggtctcattatgttgcccaagctggtttcaaactgctggcctcaagcaaccttactgcctcagcctcccgaaatgctgggaaagcttttttttttttttttttttttttgagacagtttccctcttgttgcccaggctggagcacaatggcatgatcttggctcaccgcaacttccgcctcccaggttgaagcgattctcctgcctcagcctccctagtagctgggattacaggcatgtgccaccacgcccagctaattttgtatttttagtagagatggggtttctacatgttggtcaggctggtcttgaactctcaacctcaggtgatccaccggcctcggcctcccaaagtgctgggattacaggcataagccaccatgccctgcggggaaagctttattttttaatcaatttattcaatatgtattacttacacatagttcaaaagattaaacataaatatccttcagaaccaaactcactgaataaaactatggtacatccgtataatagaatattgtgtctccgtaaaaaagaatgagaaacatcttatataccaatacgaagtcctctccagcatacagtaagtggaaaaaaaagaaaaggtacagaacagaatacatggtatgctacctttagcatatgaaaagagaatacatatattttatttttgaaagaaaaatattaggatgattaatcaaagacttacaaaaatggttacgtatagaggagtgagaaaacaggatgaaaaagatggggatgaaaatgagattcctggccaggcacaatgactcatgcctgtaatctcagcactctgggaggctgagacaggaggactgcttgaggccaggagttcaaaaccagcctgggcaacatagcaagaccccatccctactaaaataaaatgtaatttaaaaaaataattaggaaggcacagtggcacgcacctatagtattagctactcagaaggctaaggcagaaggatggcttgaacccaagagttcaaggctgcagtgatgtatgattgtgccactgcacttgctctatcactccagcctgggtgacagagcaagacctcatctctaaaaacatttaagaaaataaaaatcctttttttatatggtttctctttctgaactatgtaagtgctttacatattcaaagaataaaatcaagggtttttttttattttttttttgaaatagggtttcactctgtcacccaggttggagtgcagcagcgcaatcacaggtcactgcagcctcaacctcctgggctcaagcaaacctcccaccttaggctcccaaagtgctgggattacaggcgtgagccatagcacccagccaaattaagtctaaaaacaggaaaagcaaatcctaaaataaaataagtagacctaactgcatattaaactggtaacaatcaaactgagaaaatcattatttcaagtgacttttgaacatagtactacttacaataggtacattcttagtaggatacagtctaaggacaaaaagaaatgcaaagaaattttgagtctcactgagcagtttcatttatttttgaaactattttataaatacttagaaaaaacatacatcaatgttaataaaaactatgattttcaacgtaaaggagattaaaacaaaaataatttaacaaactaaaaggaggaggaggaagaagagtagggagaagagaaggaagaaacccataatgttaaacttgagtaagaattatcaagatgatatcatgctttttactccctcctgtcaagagcctcaatgacagcccaataacaaggagcatacttagcacctaaatagtggtttctaaatacaatctcggcagagtgtagtgactcatgcctgtaatcctagcactttgggaggctgaggcaggcagatcacctgaggtcaggagtcccagaccagcctggtcaacatggtgaaaccctgtctctactaaaaatacaaaaattagcgaagtatagtggcgcgcgcctgtaatcccagctactccagaggctgaggcaggagaatcacttgaaccccggaggcagaagttgcagtgagccaaaatcgtgccactgcactccagcctgggcgacagagcaagactttgcccctcccctccaaaaaatattttttttaattaaataaatatataaataaatacaatcctccactgtaagaagacaaagcttcttggagaaattgctgattccaagtctaaagcaggaaaagtccatggtgagccaagatatcgtgtacccaaaagtaaggaatcattcaaagactaatgggttcaggaaaaaataattcaggaacctgtttgaagaagctcccactgtccttatttgagacaatttgagcatcaaaaaaaaaaaaacgtctgcaaatgactataatacaacaaaagtcatgagaccattaaaaacctcatttgctactattgtagatgactattacacaaatcctcactctaaaaattaaggaaaaaattaagcatttactgttctcttttaataggaactgttgttcactcccagttgataaaggttacaaagctcttattaactgaagaataactaataaatgaaaaagaattacagaattagaaaaatcgccattttgcaatccttaattaaatacctaaggatcaaaaaagatgctaaaattattagagaaagaatactgagaaatggaatatttgtatggtaccaaagtatcagtcccacagattattgtacataacaggagaaaaaatttacttttaaaatggagacataagcaaacaccaccttaaacctatcgaacttacatcactgataggaggacagctgacattatgtgcctcccattaacacacaacatgatatacaacatcacctacagagtgttcttgccaaaactttttaatatgaatctattcaatcctttacaatataacttccagtttacaggacatacaagcaccagaagaacaagttaaacaatctaagaaacaatcagaaaactctagaaaacaggccattctacaagatgattggtctcttcaaagacatttcaatgtcacagggaagagaaatgtgggaaggaacttcctacattgagagactaaaaagagataatcaaatgaaatgcaaaaactaaaagtgagttctcttttgaaaaaaacatttttcaggacagttgggaaaattcaaatataaattcaatattaaattagggtattatttttcctaggtgttggtaatagcacactggtgatacgaaaaatatgtatttcttagaaaatatatacgaagtattttgcagtaaacttgtcatgacacatacatttttttttttttttttgagacagagtttcactcttgtcacccaggctggagggcaatggtgcaatctcagctcaccacaacctccacctcccaggttgaagtgattctcctgcctcagtctcccgagtagctgggattataagcacccaccaccacgcccagctaatttttgtatttttagtaaagacagggtttcaccatgttggccaggctggtctcaaactcctgacctcaggtgatccacctgcctcggctttccaaagtgctggggttacagatgtgagtcacggcacccagccgcaacttactttcaaaaggttctgcaaaaatatatacaatcacagccgggcgtggtggctcaggcctgtaatcccagcattctgggaggccgaggcagcaggcagatcatgaggtcaggaggtcgagaccatcctgactaacaccgtgaaacgccacctctactaaaaatataaaaaattagccaggcgtggtggcgggtgcctgtagtcccagctactcgggaggctgaggcaggagaatggtgtgaacccaggaggtggagcatgcagtgagccaagatcatgccactgcactccagcctgggtgacagagcaaggctctgtctaaaaaaaaaaaaaaaatacacacacacaatcacacagggaacaataatgcaaatatggatggcataacgctatcttttgaatctagttgatagacataattagtgttctcttccaacttttctatttctttaagatcttaattataaaacaataggggagggaagaaagagaactaaaagaaaacagagttgcaaaagcaaaataagacaaaaatattagtcgggtgcagtggttcacgcctgtaatcacagcattttgggaggccaaggcaggcggatcgcttgaggtcagcagtttgagaccagtctggccaatatggtgaaaccctgtctctattaaaaatacaaaaattagctgagtgtggtggcacacacctgtaatcccagctacttgggacgctgaggcacaagaatcaagaatcacttgaacctcgaaagtggaggctgcagtgagccaagatcgcaccactgcactgtagcctgggcgacagagcaagactctgtctcacaaaaaaataaataaataaataaggcaaaaaaaatctaaaaatcgtttataaacatgtccacacagtcacctaagaactttctcccttacattaaaaaaaaaaaaaaaatctagccaggcagcgtagtggcacacatctgtagtaccagctactcaggaggttgaagtgggaggactgcttgagcccaggagcttgagtccagcctgggcaatacagtgagatgctgtctcaagaaaaaaacaaaaaggaaattccaggccgggtgtggtggctcacacctgtaatcccagcactttgggaggccgaggcaggtagattacctgaggtcagcagttgaagaccttcctggccaacatggcaaaaccccatctctactaaaaatacaaaaattagctgggcacggtggcaggcacctgtaatcccagctacttgggaggctgaggcaggagaatcacttgaacccggaagccggaggttgcagtgagccgaaattgcaccactgcactccagcctgggagacagagcaagactccatctcaaaaaaaaaaaaaaaaaaaaaaagaaaattccagagattactcagcccactatcatctgatcaataaaaataaacagatttcaaacaaatacttacacactacaaacagcaatagtactaaaatctgtcaattatttaaggaatgtttgtcattgacaaacagaacacattttgttatgataactcacactgaatcaaatacattctaaaatccattaatcttatatgctaagacatcaagagaagcatttctttgcagtattttttcaaaaatattttttaaatgccccaatgccacaagaaatattttaactgaaaaaaatcacacttgaaagacaactagtagacagactgccctaatatctgcttcttttagcaacaaactttgattagccatttattctaaaagccacacagtgaaattcttaaaattcttgatttcggccgggcatggtggctcacgcctgtaatcccagcactttgggaggccgaagcgggcggatcacaaggtcaggagatcgagaccatcctgactaacatggtgaagccctgtctctactaaaaatacaaaaaattagccgggagtggtggcaggtgcctgtattcccagctactcgggaggctgaggcaggagaatggcgtgaacctgggaggcagagcttgcagtgagccgagattgcacccctgcactccagcctgggcaacagagcgagactccatctcaaaaaaaaaaaaaaattattgatttcacatttaaacataacaagaaataggctgcgcacagtggctcacacctataatcccagcattttgggaggccaaggcaggcagatcgcttgaggtcaggagttcaagaccagcttggtcaatatggtgaaatcctgtctctactaaaaatacaaaattagccgggcatggtggcgtgcacctgtagtcccagctactcgggaggctgaggcacgagaatcacttgaacccaggaggcagaggttgcagtgagccgagattgcgccactgcactccagcctgggtgacagagtgagattgtcttaaaaaaaaaaaaaaattaataaataaaacaggaaatagacgtattcaagagggaaaaggaagacttactgagtacctactatatgcttggtgctttacataaaaatttttttaactccaatgatagtcttatgaggcaaatattacccccaattttttttttttttttgaggcagggtctcactctgttgcccagcctggagtacaatggcatgattacagatcactgcagcctcgacctcccaggttcaagtgatcctcccacctcagcctcccaagtagctaggaccataggtgaatgccaccacactcagctatttaataataattttgtcatttttgtagagacaaggtctcctatgttgcccaggctggtctcaaactcctaggctcaactgatcctcctacctccacctctgcctcccaattatccccaattgagagatgaaaattctgacaagctctcaaacgttaactgacttgcccataaatgacagttccaaagttataaggctagaacttgaatccaggtctgttagaaatctaggtttgagaatccatattctctccacttaatggatttaagattcacagatataaaagcctatctaaggaaaaagaatatttaaaagaatacagttatatattcaaagagctacacaatcttacagtttaagaaaaatcaaaactgagaaaaagtatgctccaaaattattgctaattgtaaaaaaaaataaataaataaaaaaaacacacacaatttttagcaagccagctgtctatgacaggacagctagtccattcctcactgtacatgtaaaattacacttcagttgcccgctggatgaccccactgccaaaatacgccagcaacataattcacattaaaacccagaggcctaacactatttggaaagtgctttacatgtttactatacctatcccaagcatatttaccactcataattcataggccattttcagcaaatatactttgttctatcatattattttctgccactctaaaatcatattaaatgtataaaacaaaaacacctacctaaatataacatctcacaaataaaccttagtagtattatgttattttgaacttgtctattgtatgaaactatgccataattgtttctataacataaattaggtatgttctttctacaggatcaaaattccaatacctacactccttgcatgtctaaagatacacacaaaataggtacagaaacctatatgttaaagggtttcccatgtaaattaaatcctctatgagctggattagtgactagaagaaggcatgaggcagcttgtagagttctagtgatattctatatcttgatgtagatgttagttacactggtatgttcttagtgaaaattcactgagctatatatttaccagctgtgtactttttgtatattttataatttataaagtcttatatttttaggctgggcacagtggctcagcctgtaatcctagcactttcaaaggctgaggcaggaggatggctctagtccaggagtttaagaccagcctgggcaacacagtgagaccctattttttctgaacttatattttttaaaatgctcaatctaaaaacttgttttactaaaaagcactgatatcatccctcttaccaaagtagtcaaaccctagtgaagaaaacagacaagtaattaagctatttcattagaggactatgatagaagtaattactatgtgctacaggagcacataagaatggtacctaacttaatctgaaaagaggtaaaggaaatcttcctgaagaatatacacctgaactgaatcctaaaggtcagacagaaattagccaagcaaagaaaggggaaagtggaaatcagggaaatagaacatcaaatgtaaaagacgagagagaaagcacattacctgagaggaagcctaaagtcagtaagagtggattaaagtatgtaaggaagacagcaagtgaagaaaagctagagaattaagagttagatcatgaatgatctcatacacatgccatgctacagtttaaactctatcctgaaagcaatgagacagcttttttgaagattattcaataggaaaggacatgatttgatttttatctgtactatacatgtcaaaattatggtgtgggccatgctcacaaccccattttgcggtaaattagcctgcacactgtcccatactttccaccattaagatctttcctgatacccatatatacatacaaacacacagccaacaataaatggccaagagtggtgacataacctaagtacacagacttgttagcaatcaatgagaaaaagagctgagccaaatctggaattcaaaccagaaaatcctagggaaaaggaagaggttagcaacaggagctaacctcttttaaaacgttttaaaacaattgcagccaggaggcaagatgttggcatgggggtcacatagtagttataaggagcagaaattagtaataaatggaagctatgacatagggggaaaaaaactgaagaaagaaacggtatctaggacaagctaacaatggagcactggagtggggtctccagctttattaggttcttgttcttcttgagagcaagttttattaggttctttttcttcttgagagcaagttaacttttcctgggttcccttgtgtatggttcctttcaataagcacttcattacttaaggtaacttgagtctcttccctccaagtgaaagagcctgactaaaagagcattttagaatacttactccaacagcagtcaagagaatgaacaggagggcatgacaagaggcagaagacagaaggcaagaagaccactcagcattacagaagcccaacaaacagatattttcagttaaaataagatagaggcaacaaaaagtaataaggaatgacctgaaatatcatgagggaaaatgtacaaggcagtgacagactggatgttggcagtgaagtacagagtgaagcggagggcaattcccaggttcctgaaggtttcatgaggaaagagtggtgccattaatcaaggtaggaaatcggggggaagaaaaaattttgttgcagtttctgtctccggctctctctccactgtttttgtggggggaaaagaggcaggaagagttttgtttcctaaatgtttggattgaagtgtttgtgaaatgtgaatcaaagtggtgatatccattaggcagtgcttttacaggggtctagagcaaaggcaagcactctagacagcagttctagacttaggaatcaatacattaagtcaatattgtggtttttaaaatgtctgaaaagtctttgactaatatttatttcaaactgagttaacataaccaaaaatcactccaactaaaaaccttaatattcttggcaaatcatattttcaaacctcctacatttctctgctattaaagactgaacaaacttccacatagtataatccaaatgattaggaaagatggagtttatatcgctaacttctattgaggtacttgttaaaaaaaatctaagtttacccaatttccctcaggaactatatactactaaaataactaagggaaaacaactgttaaaaattcatatattagatagtgaatctcactgttaatgcttaaactagaataagttttttaaaggcacttaatcatgtaatttactaatttaaatattcaactctacctgtaatttaaatgttgggtttccatcctaaaaccttttctcctcccttctgtatgattttgcctccaaaatctactgctatcaacccagaacctgatactgagcttcagccacaaatccaaatgcctaatggtcatctacatctgacagaactacagtcacctaaactgaacatgtcacaaattaacccctctatccttcctccttgacaaaataaaaacaaaatcccactccttcatgggaatccccacctcagtgaaaggcacaagccagaaacctagattttatcctgtatgcaacttctccccaaccccaaatacaataaaatcaccaactcaactccgaatatccaagttcagatccagtctcaccatttgcctggataaccctaatattcctggcctttagtcttattctactcttcaattcactgcagccagaatgacttttttaaaatgcaaatctgatcattccagtcccctgctttaaaatccttcaataatttaataaatattataatcatcatcacagctagtcacactgtggaagctcagaggttcaatgagaaatttagttacatcctttctgtaggttcaacataaaagaatcatcaggaatttttttcaactcacaaaattatttaaacatacatataacatcagacacatttaaaagaaaagcatgtaacattgttggtaaaagcaaaacaccaaaaataacctccagtccacaaaaatggaatactatccagccagtaaatgaggcacttccatatgtattgttaagaaatgacctctaggatgtagtattaagtaaaaaaaacaggctatgtatagaatgtaaagtatgcaaccatttgtgtacagtgtcttaaaaatataaatgtgtaggtttatatattggaaatatcacagaaaggatacacatgaagctggaaatagtggttgcctctaaagaggaaaaatgggtggctggagagtgaaggcggaacagaaatttttactacattactcttccgaaacttttggcttttacgtctagttattatctataattttaatgtgattttctcctgttactttaacattttttactgtgtgtgtgtgtatgactacaaagacctctttatatttcatctttataccaatattaaaattacgtactgatcatttgatgcaacattacatttctttcttgacaactcaggagctcaacttctacaaacattttattcaacattttactgctattgagaaggctgttgttggtaatgacctcagtgaacactgcatgatttctgtacttgcttcttggagaagcaagacagcagcaccaggcaacagaagtttattattaaaccgacatcgaagcattcagggattaaggaatgctacaaatcttatttttctagcaaatccaaaaaacagtgaatccaaaaaaagtcccctagtatcctttaaaaataaaaataagaaacagttctagtatctgcagcaatcgacaaggaggtgaagtaatactacaagacgacatagttatatccactagtgcaacgtgatttaatccttacagaggtccctaaaacatcagtgctggacaacctcacacgttctacacagaacagacaagacgaggtgcaggctctgtgaccttataatggcacacacacaactggcctcatgcttccataacttcactctgcctcccacttttttcagcccaacccctccaaacatgggtctcggtcggtccccttaagccacaatggagggaatacattaggctaagcaaatattccctcaggatttcatggcaaagccctttcaaccaaagaaaggatcgcgactaaggagaaagataacaaggtttgcttgaggagaggtctgttgagagaggctacagtcggtggtgggagagaagccaaagtctgtgacggtgtctagagggactgacaccacatctaccgggagtaagaacaccatgacagcggctatctgaaagccgtgatggctagggttagtgctagtcggcttggtgatgagcgagctgggaggggttctactaagaagagtagggcgaggggcacatgggggacgcaatgggttagggggcggtcgagactttgcctgagaactgtaatcacgtcagcccaagggaggatgtaacgtagtctagaagctccattaagagtcctaagggactctgaggggtactaatggggtctgctgggttggggggaccgtgacagaatctccggggaggctggagggccggaatggtgcccggccaatggaagatacagggggtggggtctactggggatccggggccgtgatctggtgtttgggaggctcggcgcagacccgctcgcggggcgtctccgctgggacggggcggggcggcccgaccggagccaaatagcgaggctgagacgtgggccaggacgggctgcagggccgctgggcgcttgggcgggtcttacctcgggctccgccgcggtggccaccgcagccccctcctcttcgacggaagctgccttccaccctccgccccagggtaggaccggagatggcagaagaggccgaggccaccgagggtcggacggttccgggagggtgggcccagcagcctcagggtccgggcgagcggccgcggcgcatcccccgccctgtcagagagactccgcccggcctgagcaggcacatcccccgccgcaccccgcccagagagcacgcgttggaccgccgcctcaaccgctgccagcggccgcctctgccggtgcaactactgcctccgccgccgcctctcgcagtccgggctgtcctgtactctctcaacagacacagccaaccgccgccgcgtcccttatccgcttcggtcgcgcgcccccgaccccgcgcacgcggccccgccccgcgcgactccccggctgcaggcgagcaggcgcgcgcgcacttacctcccacgccccctactgccagcacgggtcggccccgccctgtcccgcccccgcacgtgacgccactggagagtacagcgtgcgcttgcgcagacacgccccctttcctacgccccaggcggccccgcccaaattttttcttcttcaccttacggcagagcagggaactcagctttagattctccctgtactggaaagggatgtcgcaaggttggggacgaaacctctgagtttgcgaccgtagctgtcgctttccggccaacacagaggtgcctgaaggctggttggggtggtgaggcccgaggcaggtaagaagcctcctccccacttcggtttgtctcggcagtggatcgctctcccacccactcagattctggcgtatccgtgctccctcccgattctggacctggattctcagcgccgccggtcatagcccccgccccttttcaaacacgcacgctctctccacccactgccccctccattgtccccgccccgacctccgtttccattcatttctcagacttttcactgagtggtttccatgccttgggttccagaatgtcagaggcgaattaagtggtgtcagctttttgaagtgcttttgtataggagaccgtgagagaatccgcagtggtagtacaataaagtgacaatagagaaaaatgcacgggatgctgtctgcgcacagaagaggggtcccaggttgtgtaggaggataacgtgaggaagccctttccagggtgacttttgggtcacttttagaggactgtgttaaaagactagtaatccagtacctggtcaaagaaatacgaaaggaggtaaaagcagaataacgggcgcaagagcatgtgacagtggtggtctgaaagagaaaaaagaagtaaaataaacctgatggaaaccgtactagtgtagacttccctttaaagaagcatcgttataaagttagagaaatgaggaacgagaatatggccctcaggaatgttttctgtttaggtagaagactcaaaagcgtaccatgaaaccgagaagtggcctcttcgagggtgagggaggctaatttataagatcaagatcactagtggaacgcaaccttgtatgtgcatttgaatcacctgggaaactttttgttaaataaaaccaatactgttgccccactctagaccaattaaattctgggttgtgccaggtgtcattactgttttaaagctccacaggtgactctaatgctaaagattgagactcactaaactagagagaaggaagttgagacagttggctctgtaacattaagatggaggtcatttagccgggcgcggtggctcacgcctgtaatcccagcactttgggaggccgaggcgggtggatcacgaggtcaagagatcgagaccatccaggccaacatggtgaaacctcgtctctactaaatatacaaaaaattagccgggcgtggtagcaggcgcctgtagtcccagctactcgggaggccaaggcaggagaatggcatgaacccggaaggcggagcttgcagtgagccaagatcgcgccactgcactccagcctgggtgacagagcgagactccgtccccgcccccagaaaaaaaagatggaggtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtcagctgttgtctccagccttaaagctcaaaggccatccccacttctgtccccaaaatgatcagagctaagccaatttatgagatgcagagaccaacatccagagctaagccaatttatgagatgcaaagaccaacatccactctcatagagattactacatacagtgccttgccaatttagaatctttttctattatttatcatttaagttagtaatgagatataaagatatttaaaatacagctcaattaggatggaaaattaccgtattagggaaagcaggcctttaaacaaagaattcacttggcaggcagagaagctgtatgaggtaaagaccaagacagtgtatggctgctatctattaactagggttaatccaaaaacctgtctatcagacccagataagaacgagttattgttgtctagtatggctagagcatagtatggagagtagaggtgggacagagatgaagatgataaagtgggtgtgaacagattatgaggagccttgaattccatggtgaagagtttagattatattactagaagtaattaataagtacaaaaaaggttcttaacctcttttacccagtggaccttgttggcagtccaccttatagattcagtctcagaaaaatgttcttaaatatataaaatagaatacgtagtaatataaaggaaactaattttgttaagtttttaaaatattaaaacaaatgtgtgatatatatgcactttatgcattaaataaaatctggcagcaggtctaattatataatttctaagtagtgatgactataaattatattttgaaatgcctgcagcaactttaatgtgatgtgaaaatatcagatttctattggtaaaaaagagagtgctaatattgtagtttgtggtccacacttattgaagaaatgctaaatttcagctactgattattgaaaacaaagatgcaattgttttcccagtctaagttcacagaaccctgatattctagccacatcctggtctatggatcctaagttttaaaatatctcagtataatggttttaagcaagagcatgacatcaaatctgtgtttcagaaaaatgatgaagcagtgttcacttcccaacctctctgctgggatgagaggctggctctggggcagcaaccagtactatcccactgtttcctaataaccagggcctgcagagggactgagcttgtgggtgtatatgtctgtgagagtaataccagaaaataaatcaggaaaggtagattggggctatttttgtggaaatcattgaatgccaggctgtaatttgtagttactttggtagacaatggagggttgttaaaattttttggagtagaataatgtgattagagttctgtttgaaaatctagaataatgtgcaggttagattatcaaaagagaagataggaatgaagagactagaacaataagttaattaatttttgaaaaatggaatcttgggccaggtgcagtggctcaggcctgtaatcccagcacttggggaggctgaggcaggaggatcacttgagcccaggagttcaagaccagcctgggcaacaaagtgagaccgtgtctctccaaaaaaaaaaaaagaaaattagccagacatagtggtgcctgcctgtggtcccatctacacgggagactgaagcaggaggattacatgagcccaggaggtcgaggctgcagtgttcatgccactgcactccagcctgagtgacagagagcctgtctccaaaaaaaatcttgaggtgatctctagagtctgctaaattcctttatttccacaatgtgctgaccagtctagagtaacatacattggaataaatggcatacctgtcaacaggaatatataccccagtgtgggagtcagttaactttatgtggtcaagaggctagcccagtcttttgtattataaatgatattgttagtacttctaataaagcaatggccttaccataagttcacagatcttgccaaggccttcctcagtcaaactccatctatacctgtgagtcctacatttctgacttttaaaagtcagaacctgtctatacctgtgagtcctacatttctgtcttttaaaagtcagaactcctctctttttgccaattccttaaacttcttggatgggaaagaagtttagtttaaacacattagcaaaagaatgggaggtcctcaaggcccaggcaacccatctcctttgaaactgatcaataccggactataaaaacttactgctcaaatccagctagtacccaaagtatgtactgtctatatacctgtctatacctgtgagtcctacatttctgacttttaaaagtcagaactcctctctttttgccaattccttaaacttcttggatgggaaagaagtttagtttaaacacattagcaaaagaatgtgaagtcctcaaggcccaggcaacccatctcctttgaaactgatcaataccggactatagaaacttactgctcaaatccagctagtacccaaagtatgtactttttaaatgtattctaaaaaattgaatttggggtttaggtattactgatccaaatgagtcctataaaattaacttccagaactaggttctcagagaggccaccattaccaccttcttcaacataactagcctatattgactttctgtccatcaaataattggaggccatttgggtggtgataggaagaattaagtttatgcagaacttgaggttcagctatctgacaccttttgcgggaggaggaggagtgggtctatctgaaatcagaaataatacttttatgaggctttttaataatttttattacttacagaaaatttctgaaagttcctttctctggctcccaattaaatggcttactccacaatcaacttataaaagcactggatcattgtcttgatcccaaaaaatttgtcccaactatagttactattttgagcatctgtattattgtttgaaaaccttaggcttgctttccctgatggccaatgaataaaactctcaaagtcgtgtgattcattactcattaattcattagatatttattgaacctctactatgtgccaggcacatttttgaaacccactaatgagcaatttgtaatgacaatttacctcttaactatctatgaaaaaaataacttgccaggatttgaaatccttagaacaaatgagattaaaagatcatagcttttttgtgttctttcaaatagtgtgtttgcatagagctgccatgtgctgaccacagtgattatctgtgaaatgaggtaaatcatggctttaaccactccttatcagactttgttaccacatgtactaaaataaagttctgtctacacctttataaaatattatcttacacagacgtcttattaattctaatggcctctccacacctgaccctcactcctagtcatttcaaagtttgcaattgtgtaaagtcatttctcagaaaatttgaagcaaaacaaagtcaccacaagaaaaacttggtatacaccaggtttatattgaggacaaaaactgtgacacaattacaaatggaacttttttttttttttttgtgatggagttttgctcttgttccccaggctggagtgcagtggcgtgctcttggctcaccacaaccgccacctcctgggttcaagcaattctcctgcctcagcctcccgagtagctaggattacagttgtacactaccacgcctggctaattttgtatttttagtagagacagggtttctccatgttggtcaggctgatctagaacgcccgacctcaggtgatccacccgccttggcctcccaaagtgctgggattacaggcatgagccaccgcacccagcctacaaatggaactcttgaggtagaaatggtagaccaggaataaaattattttcatggtcaatgacaccttagccattgatagctgtgcctagttacagagcaataaatggagagccttggtgttagatgaaatcctaaaaagtcacctgttttatctccttggccccagacagaataaagtggaatttatagcagtagagttaccaagcatcatcatcacaccaagtaggttttgtactttgagagctgaattcctctctgaaatattgatgttacaggaatgttgtttaaattcatagctcatttataaaattgagaatatttcttacatttataactgtgttgtgttttcctgagtttttcaagatatgtttcacttctgtactttgctcactcaggaaaaatatttatttattaaaactctagcttgtcaggcactgaagttagaaggatgagtaaaatctaatctgtgtactcaagagggttatataataaatcttgatggtcattcttacatgccacattatacagatctccagatggcttaggcttagttttaaaaggaaacgttttaattggggggaaattgaaaccccaaaaaaaagccatgaacttccttcctggaaatatttttgccataaaaagcatatttggtcttggatgtgattctttttgtgaaagtgcaagttgaatcagacattagaagttggacataatcttctaattttagtaaacatcaaattatttttaaatatttgtgtttgaacatttatggaaaagagattagatttacctgttttatccagaggacagaagtaagactcagaagttgaaaaaatggaaatattttatgtcattataagagtgggaactggtacatcttttattcctcttcaatatggaaatcactgtatttactaattatgtgttcattattaaaaaagggggaaaaattaaagcacaatatcaaaaggtagaaggaaaaaggcaaaaaagtattaatcctatttcttaaaatgatatttacacttgatggatatcgttcttgattatttttctgtatatttttatcatatacagatgtttatatcaaagcatattatgaacatttttcttttaataaatttgtattgacaatattatatttaatggctgaaaactattccatcgtgtggaaaccctgttgtttaatttaccagtccttttttgaactccagattgtttccagtttttctgttacaaatactgccatggtgaatatcttgttgaatttttgcacacattgttaatgtctcccttaagttaaatttcttaaagtataatacctacatatataaatttcttaagaattccaatataatggcaaattacccttgaaaaagcttgcatgtatgacagtcctatcaaaatggggcatcatttactcatttcccataatctctcagcaatgctaattattattagttttcttcacctttgctaacttgacaggtaaaaaaatgaaattttattttaacttacatttatttgattactactctgatgtccagtgtcttttcatgtgtttattgactagtcatgtaagtgtattaactaatattttctaacaattttttttttactttttaacatttaaatttgtattctatctaaaatataatttgatgtaaggtatgaggtaaaactctttacttttttaatcaaataattaacaagttgtgccaatgctacttattaaaaaatccagcaagcatatcccatacttcaatatacagataataaagtactgatagatattcctccaaaaaaaagaaagactatttcgtggttaaataagtttgggaaaagatcatacgaaaaaaagttaaaattttttatcgccaaactctcgttagcctctagtgtgtgtgtgtgcattaggagttagcatttcctaatttaattaaccatgtaatcttttttcttttttatttatttatttattttatttatttatttttttgagatggagtctcactctgtcgcccaggctgtagtgcagtggggtgatctcggctcactgcaacctctgcctcccaggttcaagcaattctcctgcctctacctcccaagtaactgagattacaagtatgcactaccatatccaacttgttttgtattttcagtagagatggggttttgccatattggccaggcgggtctcaagctcctgacctcaggtgatctgcctgccttagcctcccaaagtgctgggattacaggtgtgagctattttttttaaccatgtaatctcacttcataggtatttcaggaaatacctatgaaagcctgtggaactgagctgtccagtatactagcactagccacatgtggctatttaaattttagttaattaaaattactcagttcttcagtcacactgaccatatttcaagaactcaatagccacaaggggctagtggctactgtattgaacattttgcagataaaagaaaatttccgggccaggcacagtggctgatgcctgtaatcccagcacgctgagaggccgaggtgggtggatcacaaggtcaggaattcaagaccagcctggccaagctggtgaaaccctgtctctactaaaaaactacaaaaaattagccaggcacagtggcagttgcctgtaatcccagctactcgggaggctgaagcaggagaatcgcttgaacccaggcagcagaggttgcagtgagccgagattgcgccactacactccagccggggcgacggagtgagactccatctcaaaaaataggaaaatttccgtcacaagaagtgctattggacagcactgctatgggaacataatgttcagtggaacacgtgaacacgctgaaaacactggaataatccataatttctcctgatttgtcaggcaaacatgattactactacactatgagaacagactctctcattgatttgtaaagactccatcatcatatttaaaatttctaatctacatatgatttttttatgctattgatttatctacttctgctccaataccacacccctagttttaagtcaaggttctgcacctttctctttcagagcagaaatgaagaattcttgcatggagtaggaaattagattagaagtgatagtaaaggcgctttcacttcccagactctaaatgtaaacatttctctgccgaacttgatttatattatgttgagctgtatactcaattacttattcatttattctacaattatttattgagtacctgcctggtaagcactgttttaggtcctggggttaaaatggcaaacaaggcagacaaggcccctcgtcgtcttattttcatagagcttacattcttgttttggagagggaaagagaagaggcagggggaggaaaaaagaatatgaaccaataaacaaataaattaaaaaactatcacatagtaatcagtgctattcaaggaattgaaattagagtgatagtaactggtggcctctttgttttggctgccctgagacctctgtgacttagtggcatttaaactaagatctgtccaaagaagaagctaattactagaaggtccaggcagagctagtaccaccctcaggagggaaaaagcttggtgtatttgaggagtaaaaagaaagtctttgtggctgggtcttagtgggcaagcagggaaataataggagataaggttggagaaatagctgaagccacattttcatgtagggttttgtaaactagggtagggaattttcatttttttctgagtatgatagctactagagactcctaagcagggaacagacctggcctaatttaaatttttaaacaattattttgatggagaatttattggcacagtcagtagtggaaataggagacctgttaggctaggtcaagaaagaaatggtgatagatttgactaaggtgatagtagtgaagatggaaagcattggacagatttagaacatttaggctatagaatcaacaggacttgtcaattggatgtgaagtgtgaagacaatagaaaactctgggatgagcctgggcaacatagtgagaccctgcctctataaaaaaaaatattaattagccagacatggtggtatgcacgtatagtgcatatagctacttggaaggccaaggtgggaggatcacttgagcccatcagttaaaggctgcagtgagctatgattgcaccactgcactccatcctgggcaacagagtgagacgttttcaaagaaagagagagggaaaggggagaggggagagagggaggggaggggaagaagaaaaaacagagagagagagaaagaaaaaaactaactcttggatgatgtctgtaatccattatatagtaaccaggttcaattttcagtctgattatggcaggcaaaattgggacacataagacaccaataaatatattttaaccaaatgaataaatttactttaataaatgtttctctcctgtacacatttaagctgctaaagcataagcttgtgctcattcctttattattagggaatctgactcctaagaatttgaggtttatgtcataaacacatcagctataggtaattattagactgttcccctgaagtatccaagccaacagaggagactgaatgaaacagaaaaaattgcctgccacagttgcaaaagttctgtgagattctcatattttatttttaaatttcatgctgattttgcattttatgcccaagtttatgttaataattaaaatatttttagttgctgatttaaatgttttaagtcaatgattaagtggtttagctctttcccctaaagttggtcaaattaaagctctaggaagatgccctgtgattaacttgtgtttgttttttggactttctttgttgctatctgctggcacatgggcatgtatccatttagagaagtacagatgcatctctgagcatttgtagtttggtacaacttaaaatcgtagccaaagcgagtgaggaaggcaatagcatttagaaacaactgacttttataatctgcacttactttgtaatgtttttaaaaaacatacctgaatgaggctgtttctctctttttatttttttaaggaatgcttactgaataattagaaaaaaatgagtaaaggtcacaattctggaatagtatgttttcagtaaaacagatttatctggagtactacttaagtcaatagccaacaggcttattttccctgaagttttgagaattgctgtatgccatataaaatccttgttaatttaaaactctaatacatattttaatcccataaaataaatacttatacatctataaaatagacaattatcgttaatatccattgtaaattagtatttttaagcatttccattcattaaaaatccagattgagtccaggtgaggtagctcacgcctatcaacccagcactttgggagggctagacaggaggatcactggagccaaggagttcaagacggcctgggcagcataatgagacctcatctctacaaatttttttttttttgagacagtttcgctgttgttgcccaggctggagtgcaatggtgccatttcggctcactgcagcctccgcctcctgggttcaagcgattctcctgcctcagcctcccgagtagctgggattacaggcatgcaccaccacacccggctaattttgtattttttttttttttttttttagtagagactgggtttctccatgttggtcaggctggtgtcaaactcctgacctcaggtgatccacccacctcggcctcccaaagtgctgggattacaggcatgagccactgcgtctggccacattttttttttttaattagccaggtgtggtgggaggcacctgtggtcccagctacttaggaggctaaggcaggaggatcacttgagcccaggaggtcaaggctgcagtggccgtgattgcaccactgcattccagcctgggggacagagtgagacccagtctaaaaaaaaagaaaaaaaaaatccagactgaaacagcaataacacctccagttaaaagttaatctggccaggcaccatagctcacacctataatcccagcattttgggaggccaaggtggtggatcacctgaggtcaggagtttgagaccagcctggccaacatggtgaaaccccgtctctactaaaaacaatacaaaaaattagccaagcattgtggtaggcacctctaatcccagctacctgggaggctgaggcaggagaatcacttgaacctgggaggcagaggttacagtgagctgagatcgcgccattgcactccagcctgagcaagaagagcgaaatgccatctcaaaagaaaaaagaaaagtcaatttatctggaaactgcctttaagatagtttaataaatgtccccagtgctttattagaattgtaaaagttcttaaaattaattcaacctggaaatttacagattacataacagtgatctagaatagggattggcaaactttttctctaaaaggccaaatagtaaatattttagactttgcagactactctgtccttagaggtcaaaagtagccataaacagtatgtgaacaaatgaacatgacttagtccaataaaactttatttatagaagcaggcagtgggccagatttggcctgcaaactgtaatttgctgacctttggactagaaaactagaatgttttaggatttttttttttttttttttttttgagacagagtttcgcccttgttccccaggctggagtgcaatggcgtgatctcggctcaccgcaacctccacctcccaggttcaagcaattctcctgcctcagcctcccaagtagctgcaattacaggcatgcgccaccatgcccagctaattttgtatttttaatagagacagggtttctccatgttggtcaggccagtctcgaactcccgacctcaggtgatccgcctgcctcagcctcccaaagtgctgggattacaggtgtgagccactgcgcccggcaggatttttataaacaggatgacagaatttaaaaattggcagagatgacagcttagaatcatagaatatagagctagtggaaacttagaaaagagctagtggaaacttagacatcagaataacttggaaatatcttaaaaatgcagaggcccagattctatcccaggtgtatgctctttaaaatccccacagataggtgggcatggtggtgcatgcctatagtcccagctactcaagaggctgaggcagaaggatggccttgagcccaagagttcaaggatgcagtgagctataatcacaccactgcactccagcatgggcgacacagcaagacctcatctcttaaaataatttttttaaatctcatagatgattctaatatgcttccctggctagaaccactgtttacctggtccagaccactcagtttacagatgatgaagctgaaattcataggttaagtgactcttccagagtcaaacaactggttaattgtagatctgaactgaatcccaggtctgactccctaactaatattttttctactgaaccagcagcttcttcccttgtatcagcaggccatcagaatgactcctattgaattgtgaattttcccttcaagttggtttttattactttttatttaattactttgttttttataacaaatattcaagtagtgtgcatcttaaggattttaggattaataagaagtaatctccttctattaaaattaatcctttgttaaggaagtgttctacacttatgaattcaatattagcttcatttaattacagaatttggaagatacaataaactaacccctgtaatgacagggtttgtgtatactgacaacacattaacatcattgcttcactcagattgagagaacaattttccctggacttagcattctctctctttatgccaaagataaagcacaagagcagagtcatgccatggctagttccatctttgataactttgtggctttatataaagagacaagtgctttattttcaagaaatctttggggtccattattgccacctcaaacatagggaacagggaaggaaactaagtttttttgagagcctactgtagatcagacaaggtgctgagtgttttcactcatgtttttaattcgtgtaacaacctgtgattatgttattactacctcatcttacagatgaggaaaatgaggcccagaaagaggaagaataacttgcccacgatcacttaaatagtaagtggcaaggtcagagcctagacccaagacttcctagccctaaaacatagaactatgtgtttggtaagattttacaaatagaactataaggaggtcattggctccccagttgactcacctttcttgcccttcccctagtcttgcttaccatccaccaagaccaagtacacagatccttttaactctaaacgaatttactattaacagcagaacaataaaggataacaggcaaagcataaaaccaaagaataaggatgttacaaagaatacagaaatcttaagtggccttatttctttttttcccgtaatctaaattttctgacttccctttaaaaatatttcattcatctggcaaacatttattgcacttcagatatgccaggcacagtgctcactacatagaaaatattcctaaatgattatagatggctcttggttttttgctaggtccccttccatctccttttctcccaccccattgataatgttattatcatcctctcactcacccccaactgaaaccttcagaccatttcataattctttttttttttttttttttttaaacagagtctcactctatcccccaggctggagggcagtggcgaggtctcggctcattgcaacctctgcctcccgttttatctaccctcctctgatcacttactgagtcttattgattctctgtctacaatatctattcctccacattcctactatcatttctcctgctttaggtcattacctcctacctttacttgcaataaaaatctaattgggctgggcacagtggctcatgcctgtaatcccagcactttgggagggcaaggcgggcggaacacctgaggtcaggaattcgagaccagcctggccaacatggtgaaaccccgtctctactaaaaatacaaaaattagccaggcatggtgccaggcacctgtaatcccagctacgcgggaggctgagacgggagaatcgcttgaacccgggaggcagaggttgcagtgagccaagattgcaccactgcaccccagcctgggcgacagagtgagactcacctcaaaacaaaagaaaaaaatatctaattgatctctgctttcaatttttcccttaccaattagttctatatattatagctgaattattatcttcccaaagcattgacctggccattaatggctcccacttcctccagtataaatttcaaactccttcactggaattcagtctgtcaccacttagcttctaagaatcctctaatatttgcctgcacctctactactcccacttcattctagcacgctagactattcaagattctctccacatttgaaagcactttctttacctctctgtcttccacatgcatccagctccacctgtccttcaagagcccacttttatgccactttcctcaaagccatttctgatctgagcactcattccttttcatcctgttagccaggaatgattattctctcttgtgaattcccatacattctgtttgtgcctcttatggatttcttatctcattgactagaagccaccttatacatctttgtatctcccatagcatctaatatgaggtgctcagtaggtatttattgactaaaataatggtatatgcagtacgtgttcattataacaaaataggtttaagctcagtaagggtagaaactatttcattctcactctatattgccaccccctgacacaaaggagaacactcagtagacctttgttaaatgaaatacattacagttatcagtcattgggttataaatttcctgatgccataatagatacctagaaacactttgtctttttttgtttatttgttttgggggttttgtttttttggatggagtctcgctctgtcacccaggctggagtgcagtggcgctatctagactcactgcaacctctgcctcctgggttcaagctgttcttgtgcctcagtctccctagtagctgggactacaggcacccaccatgccccgctaattttttgtattttagtagagacagagtttcaccatgttgcctgggctggtctcgaactcctaagctcaggcagtttgcctgccttggccttatgttgtattttaaaatcctagttatgtatgtttctttattttatattgacaaataccacatgataaaggtcatatattcttattctcactttaagctgggcacggtggctcacacctgtaatcctagcatttagtggggcagaggcaggaggataacttgagctcaggagtttgaaaccagcctgggcaacaaagtgagaccctgtctctacaaaaatttaaaaattagccaggcatggtggtacgcacctgcagtcctagctactctggaggcagaagccagaaacttgcttgaacctaggagtttgaggctgctccgagctatgattgtgccactgtgctccagcctgagcaacagagcgaaaccctgtctttaatataaaaataaaaaatactgccttttggcccaaaatgccatcttccagtaatttgccaaatgactaacacaaagggaaagaggagaggtatccaatatatgttctctaggccttggaaaaaacatggagttgttcctttggccatgtatatgcgaatctataagaaatatgatatcgtagacatcaaggaaatggatactgttcaaaaaggaatgtcccagaagtgttaccatggcaaaactggaagagtttacagtgatacccagcatgatgttggcattgttgtaagcaaacaagggccagattcttgccaagagaattaacgtgcatattgagtgcattaagcactctgagaacagagatagcttcctgaaatcgtgaaggaaaatgatcagaaaaagaaggaagccaaagagaaaagagcctgggttcaccctgaagcaccagcctgctccacccagagaagcacacttttttgtttgttttttgtttgtttttgagacagagtctggctctgtcacccaggctggaatgcaatggcgcaatctcagctcactgcaacctctgcctcccgtgttcaagcgattctcctgcctcagcctcccgagtagttgggattacaggcacccaccaccacgcccggctaatttttgtatttttagtagagacgaggtttcaccatgttggtcaggctggtctcgaactcctggcctcaagtgatccgcccacctcatcctcccaaagtactgggattacaggtgtgagccaccatgcccagcctcagagaagcacactttgtgagaaataatagaaagaagcctgggctgctggtaggtgttaaaaaaaaaaaaactctggactataaaaaataaaaatagaaaatattttcactttacagaaaaggaaagtgagagttaaggaaatttagtaatttatttatgatcacacagccaatgagtaacagaattgaatctaaaatttaagtcttcaaatacgaagtttagagttatttttggcaaagggtgggtttggctaaaggctagttgagttctatttgcattagaatttttggagttaaacttgctgtcatgctgtatggaacagaattaaggccttgattaacattttgtctatgtgcttggtattttaaaaatcaaacagacaaaacacaaaaactatttctgaagaaaatcttagcccagcttgtggacattcccttcaaggtgagagatgactgactgttgaggcagtcttcttgcaggttcctttccctagttgggttggtgttgaagactgggtgtgatttcagcaggcagtgtagagagtaggtctccgggtttttgccaagctatatgacctggcactcacaagtatgcagtgtttattgaagacatgagagacagatgctgtagccagggagcagtcattctgcctttatattataaactcttacatcaagtcacatcgacaagctgattacctaaactctgtcaaattgcttttgtttgattgatctgtgcccatttgccataaggctagatagtaaagattattataggaaacaatcctgtctgtttcatctgttgtaaggatactgtgaggcactatttgttatgatgcaccatgtcttttatgaaaatctcttgagaaaaaactatcggactataatacaaagaattattttacctctcctgagcaattgctttgtttttgtcttatggacattgtgaatgtttacctttctctggccagatgccaaaaagcttagagccaaatttgtggcccacccataacaaatgtgctctatgcctcattaacttcattcttggctccagtttatgtctctccactagtctttttttcttaagaagatcctaattcatgccatcttattatatattttttcttttttctcataagtagccttatgttgtttctcaaatagtcagattatgacatactgtgtctacataaaaccatgttggatgccccttcatttactttggctttttttcttgaggggtgtattgatttttcatataggtttttgcagcgttttgttacacgaaaatggttatatcacaaaaattattgcttaatagtgtagacaagtggtaaaataactggtctaatggtcagaattgattaaattgatgtcataattctagtcttgtcttttacagcattattactattttcttataatatgctttgttttgcactctcaatctgcatgtgacagtttattgctgtgtgattttcagaaatattgtcgtgctgccaggtcactgcataacagctaactctctgttaactctgttgagtctgttaggctcaaatattctacacccatcagacttgtctcactttgggtggtcacaggcatattaatttcatcacacaacttgtcttgcttctcctctaaattagtcattcttttatttagacaagataatgtgaatggatatttgttttcaaacctcattttctttgattggtttggagctctagctggattttctgattatcttactaatgtcatctaattgataaatattattgtacaactttttaaactcttttagtacttccaagtaaaattatttggtcttctctacaactctctagggtatgtaaggtgggtatatgccttttttacagatggcatacaaaaatgattaaatgattttatatgccatctgtaaaaaaggcgtatacctttttagaaaaacaaggacaaagtcatttaaatgactgctcaagatgataccagcaaatcagtggtaaaactaggactagacccaggtttccagaatcttatcccatactaccttttaaaagaagtcaaaagaagttctaacttatattgtaaacattacttcatctttatcataccccttgaagctaaagctatgaaacaggcaaacacatgttatatcactcatgctcatagcagggcagaatcaggaatgaatttcatttgtattagtctcatgattctctgtttttaaaattacagttccttttaactactaccgtaatcactgtcacgttccattatggaaggaggaagcaatattttatcttatcttttgaaaattaatgttgaggccaggcgcggtggctcacgtctgtaatcccagcactttgggtggctgaggtgggtggatcacgaggtcaggagatcgagaccatcctggctaacacagtgaaaccccgtctctactaaaaatacaaagaattagccgggtgttgtggcgggcgcctgtagtcccagctacttgggaggctgaggcaggagaatggtgtgaacccgggaagcggagtttgcagtgagccaggatcgcgccactgcactccagcctgggtgacagtgcgagactccatctcaaaaaaaaaaagaaaaagaaaattagtgttgaaatgaaaagtatttcccttggaaattagtaactttttagattctttgaattcatctttaatataaaaataatttgttgtcattatgcatattcattaaggagccaaataatacagttaatggtatggtgtttggtaaaacattagctataattttaatctctgtgcttcaagaggatatttaaaattcatgcttactgtgtacatggcaagtttccagttctcattctaactaatcgtttacatgtagcacataagctagaatttcttatagttacagttgacccttgaacaacacaggggctaggagtgccaacccccgtatgcagtcaaaattctaggtataacttttttttttttttttttgagatggagtcttgctctgttgcccaggctggagcgcaatggcatgatctcagctcactgcaacctccaccttccaggttcaagcagttctcccacctcagcctttcgagtagctgggattacaggcatgccccaccacgcccggctaatttttgtatttttagtagagatggggtttcaccatgttggccaggctggtctcaaactcctgacctcaagtgatctgcccaccttggcctcccaaagtgctgggatttcaggcgtgagccacagcacccagcctaggtgtaggatttgactccctaaaaaaatacgccaggtgcggtggctcacgcctgtaattccagcactttgggaggctgaggcgggcggatcacaaggtcaggaattcgagaccagcctggctgatatggcgaaaccctgtctctactaaaaatacaaaaaaaaattagccgggcatggtggcacatgcctgtaatcccagctactcaggaggttgagtcaaaagaatcgcttcaacccaggaggcagaggttgcagtgagctgagatcgtgccactgcactccaatctgggcgacagagtgtgactccatctcaaaaaaaaaaaaaaaaaaaaactttactaccaataacatagccaattaacaataacatagccaattaatacatgttttgtaaatgtattatatactgcataatatataccttaccaataacatagccaattaacacgttttgtaaatgtattatatacatttacaaataaccttaccaataacatagccaattaacacgttaccttaccaataacatagccttaccaataacatagccagttaacacatgttttttaatgtattataaactgcattcttacgaaaaagtaagctaggggaaaatattaagaaaatcataaaagaaaatatatttactattcattaagtggaaatggatcgtcataaaggtcttcatcctcatcatcatgttgagtaggctgaagaggaggaggaaaaggagcaattggtcttgctgtctcaggggtggcagaggcaaaagaaaatccatgtgtaagtagatctgcacagatcaaacccaccttgtccaagggtcaactgtgtatttttttaccacaaccctataaaagtaactactattttccagccgcattttacagtcaggtatttattgacaataatattgtcttctagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattaccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacatctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggacctctcagtttgctcactgattgggtagacttgctactctggattaataactgcttttctctgccttgtctattagccatgcacacacttcctccttatatccaaagttctttggttctaaaattcatagttgataccttcccaaggttacctgttgtttcagataaacatttgttcttcctgatagttataggttttcctctctgtccttaattctggcagaattgtttttagttatgtcatggtaatttcaggatgatttttgtatctgaaacttaacagacttagagttggtttgttttttaaatataaaggaagaaaagtgacctttctcagcccttttacttaattaaaaatgcagggaatgtaatttgtaaaatgtggaaccaagagtagaacgaaatactatccctccagaagcactgatgtgtttcagttgtttcaaatagtaaacaaccagatgacatgttaggtacacaaattaattctattcctaatgagaattagattgcaaggcctatgagacttgaaaaccaaagatgagcttcagccatgaaacttatttcagctacctccccagcctaaccctgcccccagccctcatggcccaaaataacctcaccactcagtgaccacagagaaagtaacttggttccttttagccgagaagggaaaacacagtaagggtaaataagtacaggttacatagcaggcctgagtgagcaggagctgaaactaaaagtcaaagagaaagctatcaaaaaaagtttccatttcaagtcggtacattttggataaaaaccagtcctaatggaagatggggctaggaaaaagattaggaactggcagtcatccatagaggtgaaatacagagggagggacagcaagagaagtgacaaaggtcactgatgataggccacaagtgtagataaagataagaaaacaatgttatttcagtgactgttgacttaggcagctaatctagactattaaagtcaaatcctctctgggaaaagttatctttctgacaatgcaaagtatgtttatttaaatatcagagtatcttcaatctgagaattaaagcatatgaaagcaatctttcctaactccctacgattcatcttataagtaaatttataagtaaatttttaaactacactagtcttttaaatatatatagaaaaatatatatacacacgtatagacatgtatatgtaatctatctacatatatataaaaaatgcattttccaaatgcattagcctgattggactgtgccacagattagtgtcctcctatgaaattttgagtatgtcatttgtaaatgttagcattataaattgcaggagaatttaagaattgacttgtatttcactggatactatagtacccggtaagttacacacctgcttgaccacataccattcatgttacatgacacaaaataggaaaaaatcttttgctggtattgcgttcccttctctcttagagtcaaaaggatctattctgcaaaattaatcaaaatattcaaaaggaaggcaggtttttcaaaactgggctaagcaattatcaaactgaactaacctgctttcagatatcctgttgtattgcccggtaagtatagtcacacttgtccaacccgtgtctcaatatggaattcagaaaagttaccatatataaacccagctataaatggttgtagaaaatataagtatcagtgggtttcctatgtaatagtgtttaaaacacaaatatttcaaccatttggcaaggtatatgttgaagttcacaagcgctggtcctaaccagatcagataaagtggattatgtttctgatatgtacctaattattttgactatactataattttacaatatgcatattgaccgtatgttttaataacacattccattgaaatgaccaagtagaatttctcagttacatggggcaggccgggcgcaatggctcatgcctgtaatcccaggactttgggaggccaaggcaggcagatcacctgaggtcaggagttcaagaccagcctggccaacatggcgaaaccccgtctctactaaaaatacaaaaattagccgggcatggtaggtgggcgcctgtaatcccagctactcagcaggctgaggcaggagaatcacttgaacctgggaggcggaggttgcagtgagctgagattgtgccactgcactccagcctaggcaacagagcgagactcttatctcaaaaaaaaaaaaaaaagtatttacagaaatgtacatgctatggtgttagagcatgaatgtcaaatccagggtctgtcagattcagtagtctcatctacaaaataaaccttgttttccttctgtcctactcagttccattttaagactaacaacaagtttgaaaacttagttttatattgctatgcagctaaacagctgtgtaaaaaatggctgataattactgttatgtacaaaagagaaacttattcaaggatggtgaatagcaacaactaacctttttatcactctgtaatgtgcagggtactttatgcacacatattacacaagtaccttgcatattatatatgcatcattatatatattaccatatatataaagtaacttgtacatttttgaggttctatagaaatatataatctcattaattcttatgttctcatgtttcaacaggtactgttattctcattttataaataaactcagaagctcagtcacgtggcctccatctcgtctcacactttttccacctattcctttctccctgtcctagaaaatggcaagaacttcacacttgaacattttaaatgtagtctagcctcagtttctaaatttcatatattcagctggtatgttacagaaactaatagtgagaaattgtcatctgaattaactgctaggcagcaggacctatataactggcttggttttatatattaagtcatatctggatcagctccttatactgctctgctggtttagggcaccttaaaagccctacattggccgggcgcagtggctcacgcctgtagtcccagcactttgggaggccgaggcgagcagatcacgaggtcgggagatccagaccatcctggctaacatggtgaaaccctgtctctacgaaaaatacaaaaagaagttagctgggtgtggtggtgggcaccttgtagtcccacctactcgggaggttgagacaggagaatggcgtgaacccgggaggcggagcttgcagtgagctgagatcgtgccattgcactccagcctgggcaacagagcgagactccatcatctcaaaaaaaaaaaaaaaaaaccctacattttatgtcctgtgttaaattacctttaatattacatgtatatgaaagacgggaagttgaacaagagcagcagcgtggggaatctccaaaaaagagggcttaaaggaattgcatcaaataaatgggactaagcaaagatgccctgcacaatagtggcaaaattggtcactaagttccaatatgaggctgaaattccactttgagatggagtctcactctgtcgcccaggctggagttcagtggtgtgatcttggctctctgcaacatccgcctccagggctcaaccagttctcctgcctcagcctcctgagtagctgggactacaggtgcccgccatcacacccagctaatttttgtattttcagtagagatgggatttctccacattggccaggctggtcttgaactccaggcctcaagtgatctgcccacctcagcctcccaaagtgctgggattagaggcgtgaaccaccgtgcctggcggaaaaatcaagttctgaatacacttaaattttcttatgtagggaaaaactaacatctcagagtgtcaaacgaagtgatagtcgtcttcagtgtcagcagtagggaagaattatcattactctggaaaaaatcttacatcctgcagtttgcattaaaagacaaaggctgtttccgggatctttgtcctccgtgtaccaaaaccaagcaacttgtatttagaagaaaaccctttctccatgatgcaggctcaggcaaggttttctacagtaggctttgcttccctagccagctcctgcttcagctcctcacagctgctatctcagtcttcattcctcaaacctggacaatgctcacctccaccctcactcctactttagagagaaaatagaagctgtcagacatgaactccttcaacttccctgacgccaggtctacaagcctacctatatctgcccgttttggcaccttcttcacttatttctattacagagtgacctcagagctaaggctaaccctccatctgcacagggatatcctgcaaacaatttacacacatcatcaccatcagtttctctctattgcctcctttccatcagcatttaagtgtgtaaaatctcccctacctttactgtttattttattttattttgttttattttattttttgagatggagtctcgctctgtctcccaggcgggattgcagtggcactatctcggctcactgcaacctccacctcccacgttcaagtgattgtcctacctcagcctcccaagtagctgggattacaggcgggtgccaccacacccagataatttttgtatttttaatagaggcggagttttgccatgttggccaggctggtctcaaactcgtgacctcaggtgatctgcccaactcagcctcccaaagtgctgggattacagacatgagccaccatgcccagcctattatttatttatttattttgatgggagggaatggagtctcgctgtgtcgcccagcctggagtgcagtggcacagtctcggctcactgcagtctccactcactgcaatctccacctcccgagttcaagcaattctcctgcgtcagcctcccaagtaccagggactacaggcgcacactgccacacctagctaattttttgtattttagtagaggcaaggtttcaccatgttgcccaggctgatctcgaactcctgatctcaggcaatccacctgcctcagcctcccaaagtgctaggattacagacatgagccacagcacccggcctcccccatctttaaaaataaatagaagcatgaccccatgtctccctctagatactgaccttttgcttttcttcagagccagctctgaagtatctgtagtcaatcacaattcctcacttccctcccacttttctacccagtttaatctagattctgccccaactacttaataaaacattaagatcactagtagtttctattttattaggcctcttagcaacattaaaccctccttctcaaaccactgttcctagttttcctcttttctgaaatcacatttttttttttttgacagggtctgtcacccaggctggcaccatcatagctcactgcagccttgaattcctaggctcaaacaatcctcccacgtcagcctgctgagaagctgagactacaggtacatgccaccacacccagcttgatctctctcttatttgccagtttcttctttacttgctatagcttctcggggttttgtctcataagccctcttcttttcagcctgtacatacttgctaggctctcccattcactaccaaggtcaatgactgattgacgcacttcacatgtacacttctgtcctgaacttcaacttgtaatccatttacctgcctgctggtcatcttcgcttagatatttcttaggctcctcaaacccaacaaacccccaaactgctcttgccttatcaaacttgctccatcagtgttccccacctcggaaaatggcaccactgtgcaacccagctccagccagaaatctaggagtcatccttgactttcctctcactttgcatttatcagcctcctagtcctgttgctctacatcttaagaatcctttaaatccatgtatttctattgccaatgctaccactctagtccagacaatcatgccctctcatctgggttgctagactagcttataaaggactcttcagtgttcacttatactcttcacccccactccattttatattctgccaatatctttaagaaagctctgtataacctggtcccttcccactttccctgcctctttgcaatctataccactcttgccttagcttcctgtgttccagccctgcaggccttcttttagttcctcaaacacacactttcttttctccctttccagtctccccatttgctgttccctcctgcactctctcccatagtcctcaacagataatcttctatgtcatctcttcctcaaagaaatcatccccagtgcatctgactaatttgctttccttgttaattcctcagaatcatgaatcctttcagtgtgcccaaatcacatatgatttttggtgttgtgtccttccttcccactaaatcacaagagccatggaggccgggaaccatgtctgactcgttcactattgaatccatgcagtttcatacagtgcctggcacataaacattgttatttgttgaatggataaatgagaacatagaagctgtttatcaaagaaaaaacagcccatcatcctccctggcatagcagcagaagtcaaaatgcaacattaatcagtagaactattcatgcttgcttaagaccaagctcagaggttgatgaacttaagcaacctaacagaaaatagggaactccctaaacttgtacatctaactgtggacatctcttcagtttatctgctgacttcttagagattttcacattttacatcgttgtaatccatgtctaagcactatcttaattctgctttttacaaatttccaccttaatcactgtttacttgtgcttaaaggtaacattgggttacattatatttatagattgtgattttcttagccaattccccactgccgggctttttggttagttctgatttgagattgttatgaatagcagtgctacaaacattcttcataagtaacttatttcacatgttctccttgaatacaaagtgggattaagatttcaaaacatatgaacagtttatatcctatcatgtagacagccagagatttgtctaaaaagaaagaatcaatatatagtaccattaaaattctatgatacaaacctatctctagttctgtatagccctaccaacactgagggtgggttgttttgtttttttagagatagggtcttgctgtgtcacccaggctggagtacagtggtaaaatcatagctcactgcagcctcgaactcctgggctcaagcagtcctctcctgcctcagcctcccaagtagcatggactacagggacacaccaccacacccggctaactttttttttttgagacagggtcttgctgtgttgcccaggctggtcttgagctcctggctcaagtgatcctcctgcttcccagagtgctgggattataggtatgagccaccacacctggccaacattaggttttgcatttgctacatttatttcttggaacttaacagaaaactaatatctgttgagctatttctgtgtgtcagaaacttcaaggatttgacatgacgtttcccatttaacaaattaccataaacctgtaagtactattagtatcccccttttagagatgaggaaactaaggcttagagttgtccaagtaaattggaagagtttaaatgtagatgtactgattccagaacctgtattcttaactactatgctgtactctctctcctggttgtcagtgacagtgttttttctgttatatttaacagacaggaaaaattattaataaaatctgtaacctttctgatttccaagaatgtggtataatttattgctagtgagcttgtttcattgaggtaaacatccagatggagctttttggttaagaaaggtcaactcccagggtttaacacgtgtaggccaggacaatacaagagagatcagttactccaaataataaaatcaaataaatttggattttcactggatgccctagagaaagagaatgaggcctaggaaagaaagaagtagggaaaggttaacgaagagaactgagatgagaagcattccagaaacatggcaggagacaggggcctactggaagacatggccatggagaagctccctactgtagtagagaatggctgctaaatttctttaagcaatcatctatgtattgagtttgaagttttctgctttgtgatatagccttccattaactaaacctttcatgcaatttggatatactcaaccattttggtggtggatcatttggaggaatgaaggatgaggagtggcacatgatgaggcaaaaaggaaatagccaaaggaacaggggacgggacaagcaggctgcatcccatctgcaggagacacagaagcaaccttaaaaacccttggagaaactgaggtctcaggacttcccacagtggttagaaatgggtctcaggccatttcaaattgaaagaatgacccctaaacactaaattatttggggttgtccaagtttggaaatttctgggttacactgaagtgagaaagagcttgaaccacagtaaaataaatttgatgtattagcagcatttgtcatagcctttgccttgatgtatcatgaaataattagcttcggctgggcgccgtggcttacgcctgtaatcccagcactttgagaggccgaggcgggcagatcacgaggtcaggagattgagaccatcctggctaacacggtgaaaccctgtctctactaaaaatacaaaaaaaaattagccgggcgtggtggtgggctcctgtagtcccagcttctggggaggctgaggcaggagaatggcatgaacctgggaggcggagcttgcagtgagccaagatcgcaccactgcactccagcctgggcaacagagtgagactccatctcaaaaaaataaataaataaaataaagaaataattagcttccaggacaccagactcttctggttttcctccttcctcatcaggcatccttagtttccttttcctagttcttccttttcttcctgatcttttattaacagtgtgtgacagggttcactcgtccactctttcttctgtctacagactcagtcccttgatgatctcatccagcagcatgcttttaaataccatccatatgttgacagctcccagatttatttttttattttattttatttatttatttttattttatttatttatttatttatttttgagacggagtcttactctgtcaccaggctggagtgcagtggcatgatctcagctcactgcaaccactgcctcatgggttcgagtgattctcctgcctcagcctcccaagtagctgagactacagtcgcatgccaccacgcccagctaatttttgtatttttagtagacacggggtttcaccatgttggccaggatggccttgatctcttgacctcatgatctgcctgcctcggcctcccaaagtgctgggattacaggtgtgcgccaccatgcccagccaacagctcccagttttgttttgttttttttgaaatggagtcttgctctgttgcccaggctagagtgcaatggtgcagtctaggctcactgcaacctccacctctcgggttcaagcgattctcctgcctcagcctcccaagtagctgggactgcaggcatgtgccaccatgcccagctaattttttgtatttttagtagagatgggttttcaccatgttagccaggatggtctcgatctcctgacctcatgatctgcccgcctcggcctcccaaagtgctgggattacaggcatgagccaccatgtccagccaacagctcccaaatttatatctcccagacttcagacatctctcctgaaccccagactcatataccctattgcccacttgacatccccaccacttggatgtccaaaattcatctcagactgaatatgtccagtactacatttctgattctccttccaaaagctttaccactcatggctttctccacctccattctttcaagccaaaaaacatgaagtcatccttatgactccttttctgttataccccatatccaatttaacaggcagtcctgtcgtttgtacgttcagaatatatccagaatctgcatgtttccaccatctctactactgccctagtcatcagagtcattgtcctccctaacttgtaagggaggctgtctcctaactgatctccctgcttccacctttccctccctagcagtcaagtttgattcttttgaaatctgaataacaaaagattattattcacttatctactcatttcattgggagtcaaagccaaagttcttataatggtcttagatgatttcccagccctccccctttgacttcatctagttctgccccttcttcttctctctcttccagctacacctgcatccttgctgttcctgaacaagccagccaggcaccctcccttccactttagacttgttgcattggctattcactctacctggaatgttccacaaaccttattctctcatttctttttttttaagacagagtctcactctgtcgcccagactggagtgcagtgatgcaatctccactcaccgcaaactctacctcccaggctcaagcaattctcctgcctcattctcccaagtagctgggattacaggagtgtgccactaccgcccagctaatttttgtatttttagtagagacggggtttctactcttgacttcaaacgatccacccgcctcggcctcccaaagtgctgggattacagacatgtgccaccgtgcccagccctactgtctcatttcttataagtctacttaaatatcaacttctctgttggaccttccctgataatcatctaatgtgatgccctataagcatttccaatctcccttttcttgttctatatttgttcttttttctttatctcttatcaccttctaacatactatatttatttatttatttatttatttatttatttatttatttatttattttattttatttattttgagacagagtctcactctgtcacctaggctggagtgcagtggcaccatctcagcttactgcaacctccaccacccgggttcaagcgattctcctgcctcagcctcctgagtagctgggattacaggtgcccgccaccacgcccagctaatttttgtgtttttagtagacacagggtttcaccatgttggtcaggttggtctgaactcctgacctcaggtgatccacccaccttggcctcccaaagtgctgggattataggcataagccaccatacccagcctataatttattatcttagttgcttattgtctctctcccctcatcactaaaatatatagacttcacgaaggcagagacctgtatttgctttgttcactaatatattccaagctcttaacacagtgcctagcccattgtagacactcaatgataattattttgatgaaaaaataaatgaaaatctggcctggaaaatctgtaatcccagccctttgggaggccaggatggtcggatcacttgagatcaggagtccgaaaccagtctggccaacatggtaaaactccatctctactaaaaatacaaaaattagccaggcatggtggtgagcatctggaatcccagctactcaggaggctgacacaggagaatcacttgaacccaggaggcagagactgcagtgagccgaaatcacaccactgcactccaccctgggtgacagagcaagactccatctcaaaaaaaaaaaaaaaaaaggccaggcgtgtaatcccagcactttgggaggccgaggtgggaggatcacttgaggtcaggagttccagactagcctggccaacatggtgaaaccccatctctactaaaaaaaaatacaaaaattaggccaggcctggtagctcatgcctgtaatcccagcactttgggaggccaaggtgggaatccagactagcctggccaagacggtgaaaccccgtctctactaaaaatacaaaaattagctgggtgcggtggcaggcacctgtaatcccagctactcaggaggctgaggcaggagaatcacttgaacccgggggccagaggttgcagtgagccgaggtcacgccactgcactccagcctgggcaacagagtgagactccatctcaaaaaaaaaatacaaaaattagctgggtgtggtggtgggcatctgtaatcccagctactcggaggctgaggcaagagaatcacttgaacccaggaggcagaggttgcagtgagccgagatcacgccactgcactctagcctgggggacagaacaaggctccgttattaaaaaaaaaaaaaaaaaaaaatcacccctaggagtctaaaagcatttttttttttaggccagggatcagcaaacttttccttaaagggacagatatggtcagatgatctttgtcataactcctcaaccctgccattggagctctagagcagccagagacaatacataaacaaaggggcatggctgagttccagtaaaactgtatttacgaaaagctggccaggctgtacagcagtctgtacttagctgattcctgctttagacaaagacacatcttggtaaatcagctctcttcattgataggccagtgtctattcatcccctctcccagttgccaaaaacaaaattctagaagggtgaatgcaaacctagcaaaattatagatcattagcttctctgcctgcatgcacatgggggcattccttactcaatgtggcccttgagtaagttgtgatttgcgggatgaggtagagagagaaatcctgctatcaggtgctgtcttgctaatgagtcttgagcacattatctgaagctttggagtatcctctagaggtttctaataggcagaatgatctacttctgaagcctcttttctctatgccattaagttctttggcactgatgatgaatttcctgcggcaaggaaaccattttttacttttatcagctattctgaaagtcaatagactgacgcagttatcaaaataactgccaatattataaggtccaggccctaacttcctgccacctaaagcaatgatactcaattaggggtagtttgcctgctctggagacacttggctgtcataaccaggggtggggggtgctactggcatcaggtaagcagagaccaaggatgtggcccagaatctttcaatacacaagataaccccctataacaaagaattagccagtccaaaatatcagtagtgctgaggttgagaaaccatgatctagacttttctactgaacttttaatccaccttgtactctactgagaaaccaatatcgccaaaccatcacttttctccttcactcctaaactgcagtagctcctcagcccggggagactaagtctgtccttgtcatcctggcacttagatcctggggattctgcccacatacatattcagactctgcttctttcagatttttatctgtcccgccctcagcactaccatactttaactgatgttaccccgcaaacacacattttgggaagatcctccccacctctctcctcagatccaaatcttactcattctttgaggcccacgcatgctgcatgcccctgtaacattaagtctgcccataccactgccttttgcacttacacggattcacccgtcttacactgttacattgctattctgtctacctcgcttcctcagctactccctgaaggagtccatattgtatttctggcctattgatctcagtttacacagcgtaaagtgtgaaaactgtattagtgtattgagattctcttcaatgagataatgagtataaaaagcactctatatagtgcctggtacacaattaagtgctcagaaaattatagtgtcatagtatctatagaagcatgcattcaggagcccatagaaggtgcttaataaattgtttaaatgtggttatatattggggagagcatgccacacagactagtctggtatttggaactaacagcaaagaaaaacttgcatagaaatcctacaccaattaacacaccttcatgctagactgaatccaggagcaggggtgtcatgttttcccagagtggtgcccaacccaacctttttgcatttagcaagttaatgaacaccttgtgaataacactttgccaactctggcccagtttagaaggctgccaataggatatcagtatgccacaccgtctgctttcctggggaccctgctgtcctctccctaagtgcttctgctttcagccggtggagagtctgatgtgcctagagaagttgcgcagtgggacgaggctgcagcgagagcctggcctttccccaggcggaagagagccttgtctcagatcctgagagagaagtgagtgggggcatggcattccgagcagcccaggtttggctttgggccaggcactgagtggcaaacaagaaggaacacattccgggaaggcaaggagccctgccagcacgaaggcagcagcgaaagcagggctctgctgggtaccaggtgttccttggctctgtggaggtcaggcacgcaggcggatgaactcaggtttctctagaatatcatttcagaggcttaaatgcctcccaccctctcgctgtcagcggacagggcatgtggaactgttaaacgttaaaactctctgctctggggcccagcccgtgctctctaaataaaggtaggagcggaaagagtgttgttgccatcatgaaatcacacttcacaggagccagatttcggcgattctgtgtctaagagaaaatgctaatccaaacaagggcaggttggagaagagcctgggatttctatgccctagaaactgcactctccacccttgcagcccagaaacacaaacacacacacacttgttctccacgcctgccttccgagtggccagagctgggggaagtctggagagccctcggaaacgccgtcctttcagaatcagcgctggcccttccccaggtgatgagagaagagagcgaggaggaccaaagcggaagcggatagagccattcttttcggggcaaatggccacacaagccttcctgaagattcccttcttactttggataggtaggtgacctggactggaggggccctgggcccgttttccccagcaaggggacaggagtagctttttctgagggaggacaacgaagtctttactcacccctctgcctctgcgtctttttgctggactttgctgccgcctagtggctcagttgtcatcacttccttctctgagagagagacagccagccttggattgagtttgaggatctagcctctcagtctagtcctgaggcaacctggagatccttctctgagaagtttctctgctctaggactccctggttctgtggcccagcagctaggagagaggagcaccatgggcttctaggcctcactcagtctggcagtcaggtagaggggccatggctggctggctgggcacctgggagagggggtgggggtagtttcttattcccaggacatctcagtgggatgaagttgtccttgagtccccctcattcctgaatgcctttttcgctaataatactgcccctcccatgacccttcctttctgctaaggcccatgttgcaaaactgaggctctggcataatgtatatttcctttctgtttccccaaatttaaggcagctatttctccctgataaagttagctcattgccatgataaatatatgattatatgccttctctgtgatgctgctgctatgaatcagtccctgggaatagtgaggagtgggcatactttaaagaattttattggattggtttctctaagtccctgaaaagcctatagattataagctatatttttctgtgtattatatccaggtgtttatttcctctagcaaaggaaagcacttggtttcaacaaccactgatctgccctaccaaactttccgatctgagctgtaatacccagggactatataaaatccaaactcttctgcttaccccaccaaactcttttcttttaacttttaaaaaattgtggtaaaatgacataaaatttaccatcttaaccatatttagcatatagttcagtagtgttaagtacattacactattgtgcaaccaatctccagaattcttcatcttgcaaaactgcaactctatacccattaaacaatagttctccacttcccccttccctcagcccctggcagccaccattctactttctgtctctatgaatttgactactccacataccacctataagccaaatcatacagtatttgtcttttttttaagagatggggtctcgctgtgttgcccaggctggtctcaaactcctggcctcaagtgatcctccctcctatgtagctggaattacaggcataagccagccactgcaccctgcccagtatttgtgcggggttttgtttttatttttttttctttctacaagcctggattccagaaattttttttttttggactggattatttcacttagcttaatgtccacaaggttcatcaatgttatagcatgtgtcagactttttttccttctcaaggctgaatattttttcatatatatatatatatatatatatttacatatccatgagtagatgaatatacatatttcattgtgtgtgtatatatatatagaatatataaacatatatatatagaatatatacacatatatatatatatgtttattcatccatgggtggacacttgagttgcttctacttttcggttattgtacataatgctgctatgaacatgtgtgttcaaatatttcttcagtttgggccctggaggtcgaggctgcagtaagctgtgatcacaccactgtacttcagtctgggtgactgagtgacagagtgagaccctgtctttaaagaaaaaaaaagaaaaatttcttcaagattattctctcagttcttttggctatatacttagaattgctggatcatatggtaattctgtttttaattttttgagtagctgctgtcctgttttacacagtagttaaaccactttacattcccaccaacagtacagttctccatatcttcaccaacccagcccaagtcattcccagagttactaattctccacatcttcaccaacacttgttatattctgtttcttttctgttctttgagagtagccattctaatgagtgtgaagtggtacttcattgtggttttgactggcatttccctaatgattagtgatgttgaagatcttttcattggttattggccatctgtgtatcttctttagagaaatgtctattcaaatcctttgcctttttttttttaagacagtcttgctctgttacccaggctggagtgcagtggcatgatctcggctcactgcaacctccgcctcctgggttcaagcaattctcccacctcaacctcctgagtagctggaactataggtgcataccaccatgcctggcttttttttttttttttgagacggaatcttgctctgtcgcccaggctggagtgcagtggcgcgatctcggctcactgcaacctccgcctcccgggttcaagcgattctcctgcctcagcctcctgagtagctaggattacaggcacccaccaccacacccggctaatttttgtatttttagtagagacggggtttcaccatgttggtcaggctggtcttgaactcctgacctcgtgatccacccacctcggcctcccaaagtgctgggattacaggagtgagccacaacacctggcctaatttttgtatttttagtggagacagggtttccccatgttggccaggctggtctcgaacttctgggctcaaagcgatccacctgcctcagcctcccaaagtgttgggattataggcatgagccactgggcccagccttttgcccatttttcaatcgggtttttttgttgtgttgacctctataacctcttttcatgtcactctcccacttagcatcctaggatactaacatgcagctagtctctctgctcctcagagacaaacatgtcctttcctaccttttgcagttgctgatccctcttccaggaatgtgttgttcccagctcctctcatgactgacttctcatcctttaagcaccagcttgtcactttggagaactttcttaaccatgtcatctaaagccacctccctctttaccactgtttatcacacttcatcatgtcactgtttcttcttgaaaatcactatctgcaattatcttgtttgtttacatatttacttggaatctacctgtacatggaatgtaagttaagttccatggacacagatatgtttgccatgttcatggctccagtgcccagcttagtacctggcatgtagtcttggctcaataatatttattgaatgaatgaatcactactagagggggcatcacagggaaaaagaaggaaggtgatatggcccaaattggaattttacctccttacataggctctgggtcatagaaaaggccacacgagctttctggctctgaactccgtatgttaattcctggatcagaggcataatcctgtttgagccagggacattgctttggagttgctcagagaaaatgggtaagtattcccggtgtccacccaacagaggcagagggctgtgggggtttgctgtggccaccctcactcttccccatatgccaagtcctttgagatttgcagagtacttgggattataggaatgacttgggctccatcagtctcctgggggctgagtatgtcagtaagagtacctgtagtgagtagtcagaggataaaaatgaactttctataccataatacactagaaaaatcaagttttttattttaaaatattttcaaaggctaaggccatagcaaaacaacccaagggtggttgaatcaaactcagggaattagaggagcatcagccaatgcaagcaggtctatataaaatacacatcatttataaatgcacacagcagaaagcacagtggccccagaggaccaggcagggggacaacagagagaaacagagcactatctggagggacaggcacacccgcaacactcaaagccctgggccccaagtgcacctccaaagtcacctacgctgcagcatggctcttgccctttctgagcctgggtatagctgaagaccaagttcaccagcatcttggcacatccacctataactggcacctctcatggcctctgacaaccaagcaaggctcagagaatggatttttatctctgtctttcagcaaggaccagggagaagtgctgaagcaagaagggttattttcctaaaaaaaaaagacggatgaaagggtgaaaggggctggttccaaaaaaaaaaaaaaaaaaaggatgaccattcatggaacagtgagtttcacctgagacatacagatttggtgcaagcaacacaaaaggccaggctctaaatttcatcctaaaaactgggatggggagagcatgaagagaccacttactggtagtccctccaattctcatttgggtttgtcataaacaggacagacagtcgtctgcttcacaataaataatttccacctggatttcattccctgattaatctctcagtgtctgaagaggggaaaacagtggctgcttctgacaccgcccaccccatcaccagcaactttccctgatacttctggcctcctcactaagcccttccagaacctccaaagccactatcttagcagatgggagtcccagggcgatgaggccagagttgtgggacacagagaagaagagaaggccttgatagaggaagaggaatatccaaggcaaagccaccaccacgtccaacctcctcatcctctacctttcctgtccccagaggtatgagatagaccccctggcctggttcctgcactgtgctaggcccacagtggacacttccaccttaatggagaataggccccatggagtggaggtccctcctccatggcctgcaacccaatgactatgggggtgacacaagtgacctctgccctgtgatggctcaacaccatcacacgcaactgtccagacaagcccccctcaacgggctgctgttggccatgcctgagatgcgggcaggcaggcagggagtggacagcaagacctcagatccaagcctccacccttcccttccctatttccagggcttgggacaccttagaaatgtttgagcacacaagggcaaaacccagtaccaggtctgtgaccacagtgatcaaaggccctgctccacttgtctcaccggaaagtgacagctgaggacacagaattcaggtacctctgttcttcacagccactgccaccatctccgccgtgggcagcatctccccataatgcagccagccacctcatgaggggccggcacagagccctggcccagagcatggaaattcatctctggctggaatcctggccatgagccctcccctctgcattcacagattctcagcaggcccctgcccaagcctgacaggtgcctggctgcccgcagagaagccctgtgggaacacagagtgttgggagggagcagagcccacatgggtggtttgtgttctgacctctgaccccaccataggagtgagctgtgtggcagagccacattccaaatgcgaaagcatggcctctgtcctttgaggtggcctccagtgttctgcctgtgtgccagaactgtttccaaggacccagtttgtttgtttgtttgttttctctaagtgtttgctgaagctttgtgtacagaattcctcagttggttccaaaaaatctggctttttgcttgagtccaaaaattgtagaagccagttactttgtaaacacgtacttcagatctctcatagagggaagagaagagctgcggggaggaggagggatctggaatattttccttcataggcagtcttagcacagcagcagcataaaccacagggatcattggtggagacttagcacccagaacattcttcttggagaaggaatggggacaaaggccaagtggctgttacctgcacacaggaaagatgtccacatcagggaaagggcccagaatgcagacggacgtgggcagaagggccagtgataactttacttcccccaagagtgggccagggtgggactggtgtaccctgcacgctgcccaaccttgcttagggtcagaagccagctcaaaacaggaccaagtccagccaggcagcctggcctgaggttcttggctcctgtcctcaaccctcaatatcaaaggcattagaaagagaaaaggcctcacctgtgcccagggactgggtcatcccaactcaaggagcataactgctgctctagccgagaaatacggaacgccaggtaggatgaggacatgaccaggaagcagatcctgaagaaagcggcaatacggagttaaatatttcttccacagaaagagcatttctggaagttcaccggaaatagtggggaccaagctacccctgcagttggaagaattaaagagccctttgtcctgcagccagttcaggcctcagcatctttcttcccagacaccatgtaggggtcttcagacttgtccccatggaagtgtccttacagcccagctagagctctgggcccttcagctgagctctggggggagctctggccagacagccagatcagtcatcctaccctctctctcaccagccatggtggtccttcctgtgcctcctctgggaggtcatgatgatgaccccctaggcggtgggcccattcccccagcaggtgctgatgttgatggtcaaaacccggccagccgagccagaggaggctgatgagctaaggtgagggaaagcaggggctggctgttcatgtcacttcccacgatgctccctgctctactggtccttagacagaggtagagacaagtcaggggttccagaagctgccctagtggtgggcagtggcgaggccaagcttttcctctctctctccaattttcctggccctccttctcccaaatccttttcctcttctcaacatctccatatcctgcccctctccaccaaatagtcttaaccctaaattacagggtttcaagaataaaaactggagatcctttctcttgctacagaagggcgtgccacatggccttcagataccacccaagagcttgaatttgactcagaaacttccccctggttctgaatagtgaattccccacactccaaggcccttgttccaagcacctagacatgcaggtgggtctgtccccctccccagtatagtcacttacagcacaaagaagaccttgaggagccggtaatcccagagcctcagctccccagtgctcctgggctcctcctccagctcatcctcctcatagacagcattctttgcagtgggagagcagttcggcatcttcttagggcaggcaggaccccagcctggcatgggccatgcccacctcccaccattttctgaagctacttgggctcttgacttttctttatggattgggagaaaaaaaaaatcagctctcagaagccctgctggctgtggtgagccctttttatggaactgggaagacagaaagtctggcctttgcaagtagttgccatggacaagccctcccgaacttaccagacattggaggcttcctggaggggaagaaactgtctgtggagtccacggatgatggagggatacaagggatgttgtctgggagagacagggacctggaggaagggcatacctttctccacttcatctcagggatgaggacttcctgcagtaagacaggagaagctatcttaccatggcccttgcgatctcacttgccctaaggagcccacaccaggtttatcagagttttctccagatattaccaaatatagatgcctagccagggatggaagcaggtacaagcgaggagggcagttgctatagcaaccatatgcctctcctctctgctcccttgctgtgactagctattctgccagcaaacgatgtctttgaacactgctagtgtagaaccacagtgggatcttagatgtgagccaacccagatacatgctcagatctgaggccaagaaagctcggcacaacatgtcttaggtaggataagttcctgctcctatcccaagccctaaccttggcagggaggacttagcgtccccatctacaaaaatgggaacttcaccttctatccggcacatggtattatgcatatcacatgcttggctaaacactaatagttactaaaggagccttcaaacaccccagggtcatttctacgccatccctgccctagaaactcagttctgcctacccagggccccagctgccaaaggaaacttctggaactttggcaaatctaaaataagtctgtctgggttcttcagggatagtctttggagttcttccctagggacatcttttattttttttttttttgacagggtctccctctgttgcccaggctggaatacagtgttgtgatcttggctcactgcagccttaacctcccaggctcaagtgatcctcccatctcagcctcctgcgtagctgggactacaggtacgtgccaacatgccctgctaatttttgtatttttattgagacagggtctcactatgttgcccaggccaatctcgaactcccgggctcaagccatcctcctgctttggcctcccaaagtgctgggattacaggcgtgagccaccacactcggctcccagggtcatctttatccccttgaaggccctcttgactcagctgaagaaaagaggatgggccactggtcctgcatctgtacaggtgtgcagcccaacctggccagtgttttggtgcttggacttctgttctactcagaaagtcagcctatcggctgggcacggtggctcacgcctataatcccagcactttgggaggcggaggccagtggatcacttgaggccatgaattcgagatcagcttggccaacgtggtgaaaccccatctctactaaaaatacaaaaattagctgagtgtgatggcaagtgcctgtaatcccagctacttgggagggtgaggcaggagaatcacttgaacccagcaggtggaagttgcagtgagatgagatggtgccactgcactgcagcatgggcaacatagcaagactctgtcgtccaaaaaagaaagaaaagaaagcctatctgctgaggccctggtggctctgcattatggtgtggcaggtttaagagatgccctggcatagcatggccactgactcttgagcctggtgccccagttctgcattgtgggcccccctaggaggcccagaagcctcagagctccaggcactgtcagtccagcagtctttgctcccagcttcagctctcaccagagactcaggttcccctgaaaattctcttacactcagactcttcttgctggaaggctgaggaggaaagggaacagcagtcacttgtccatctggaacaggcaaggtcaggcagggggaagcatcagccctctccaagagagctttacctccaaataagccactttgtgtcaggtgaagcccagctcccagggtctatagggggccccctatttaatgctggagcagagaggcaaaccccaggaaacttactctcccacctgctgccccatccctcccctcttcctcaccataggcagagagagtcatagggcatgttgggaagcagctacgcgctcctatctgtgcattaaggaagcacaagtgagggcctggacatagagacggtccctgacctacgatggttccacttaagatttttcaactttatgatggtgcaaaagtgataggcttcctgtagaaactgtacttcaagtacctatacagccattccggttttcgttttttgttttttgtttttttttgtttttttgagatggagtcttgctcttgtcacccaggctggagggcaatggtgcaatctcggctcactacaacctcctcctcccgggttcaagtgattctcctgcctcatcctcccaagtagctgggattacaggtgcctgccaccacacccggctaatttttgtatttttagtaaagacagggtttcactacgttggccaggctggtctcgaactcttgacctcaggtgatccacctgcctcggcctcccaaagtgctgggaccatacagccattgtttttcacattcagtacaggattcaataagttatataagatgttccacactttattataaaacaggctttgcctgagatgcttttgcccagctctaggctaatgaaagcattctgagatgtttaagggaggtgaggctaagctacgatgttctgtaggtgatgtgtacctctattaaacacatttttgacttacgatattttcaacttttgatgggttcatgggacataagcccatgaacaaggagcatctgtatatggggacacacaggggctcactggcctcaaagacatgcttgcaagcatagacacacaatccaagtactgtctcttgtacattgagcctgagcctttaactcccctctccctgccccattccctgtgctggagagatgggcgacctcccccaacacccttgtgcaagacctgcatccaggcctgagcgacttccctggccttcctgctcccaagctccatacctgtaggtgggtgcagactctcctcagcaggtcatatacactgtcccgggagagcagtgacacaaagatatactgggacatggaaagaaaacagacaggggtagggtgagatgagactccttgctgtgccagccagcccccttgtggattgggcacaggcccacaggggtatcaggccatgagagccaacagaagctctgcctaggaacttctcttccagcttgttgtacggcctgaaatacctactggagagctgcagggtggggtgaaataaagacctgggaatgtgcccgagtcagactgtgggctgtcagggctgggagcgggagactgacaagggagcatgggcccagtgcactgaccttctggctggtgttggtggtgatggccagtccattgggaaggagccgtgccatcttgtgttttttgatcatttgcacagacaccacaggaatgaccacctgagagggagagggatgcttctctcaggactaacccccaaggacgtggtccctttgctccctgcctagggacccagctgtgagcccagcatggccaccatggggaagcctggccccatgtggggaagtctctgaaccttctaccttttcatccaggctccccttccagttgtccctgccaccctgccccagccttggcaggatgtgtcactcttggctgtcacataggtatgatccctgttatccaggaggccaaggatggtggctctggtaaatctcatactctagtaatggagctccccaggctacttcttggccacagctagggctccgcctaaatgtgatatcccactctgattctcaaagcatttctgaaatacccagaggcagaatgatttggctgtgaactgttcaggccagctcaggccagatgtggggtccagattgggcccctgtttttgaaggggcaggactactttcctggacactggatgggatgcctcgaagctgcgcatccaaccagcaaggggcttcacccggggcccagcacgcagagagataggcatgactttgaggcatgcccgtggggcaggaggctggctcccctcacagggtcatggcagccctcaccactcattactaccttgatatccttgccaaagaggctggcatggaagcagagccagttgggggagatgtagagccggccctggaggaggaagtccctctggagggcacaggaacacactaggatgtcacaggagagaaaatggccataagcaaggtcagcccaggaagccccaggacctgggtcctcacgttctggagtccacagtccagcctcaggacctgtcttcctcagactcccccttccccaccgcaggccccaaaccccaaacagtccattccccagcgtcgaagggtccttctcctgactgctcctccactccaccagcctgctggatgtttcttccttctccacccttgctccagagggtccaggcaagttcctgccctgatctccaagcctgcattctcaccacctcaggcagaatccctgacctttccctgctctgctctgccccaagggccttgattgtgcaaatgcccccacctgctcagtgagaggccagagcaggtaagaagtcaccagtaagagcaggacacaagattccaaagccctgacgtttccccaagaaaaccttcaaaaatgcaatgctatgtccaaaccagcccagtcttctcaccagcccagtcttctcacattctaggggagtggtccacatctaaaggacagccagttcccatttctaagtcgtgctttggaggctccagagcagaggcccctggccccaggcactctgggtgcctaaccagctataccgggagacagctcacctttgagaaccacttcctccaagggaacatccttaaacagcttgtggtattgctggttgtatttattcagtgttatctgcaaacacacaggctgcgtctgagaagcgctgggagatgagaccgccaaaggggccctgctccagccaacaggaaatgccacagccccccggcccatgctggggacttagcatgaggcagctagtaagcagccagtgagtatggagggctgtgtgccaagcacagcttgtctcctggtgctgctaggtcctgacaggcagcttgtactagcagagggggacacactactcccacccaggaagggatacacactcaggtctcctgatttcctgatgacaggcccggtggccaaggagccaaaagtcactgaattctggcagcccaggaccccttcctgggtgaatagtgagaagtcagcctccagacttaccccttctcggccacacttctttatctcttcacccttcaagccttctggccagtgcagactgcaaaggagacattccatttcgggaacaaggaaccccagtcctgcccatgcatcctcagtgccaattctgccctggccttgagccagaagcttgaggcagagatcagagactaggacccttctctaggggacacagcaaaatgacaagtacagcgagcacacagctaaactatacagctcatccctgggggagggcactgcgggaggtagagaggggtcgccaagggcccaccttccccagtgcgggtgagcagcatctcctggaggtgcgcctggtctcccagagatgctgaggagcttcccacctgggtgtcaaagaccctgtcccatttctctggccaaggggtaagcaggggagcaggcagtgctggaatagggacagtttggggtgtgggtgaggtgaaggtgtcagactcacagcgccggggcctggccacaggccatgatgccagcaggactgccctccctgccgcctccttcctgtggcctgagctctgctgcggggagcttggcacagactcacctgacctggctgaggctaccacactgggagagggggatggcactgagaaaaaaaggtaaacctttgccttggccaggttggcccagagcacaggtgagcagggaggaggctggaaacccgagaagcatggactctgctaggtcccagtgcactgggacagtcttgaggggcgggaggaagaagcctggggcagcctgtgcctgacctcacagacctgcaaaggggccccggctctgccttgaggtcctcttacaaacaggtcacttcctgagggcttcccaccctctagtctgtgtgtatctatgactgggaaaggggtcctcacctgtagtccgggggctcctcaactctgtctggtttctctttgcaggacacaggactgttcagagaagctgtctttctgtgcatttgttggttgctagggaaaaacaggcccatatcaggaagggggcttcatgaggacacctttccctaacagccccaccatgcccatggccgctgcctctggcccccacccaagactggccctgatattgagggtgacactgaaaatgtcacagttcagaggcagcagcgcaggcagaggttctgggatggctgacggagtaggcgggtctcacacagcgtctttcccgaaagccagaagttctgcttatgcctaggctgggaggaaaatcaacctgtctacctcatctccagtgccaggcagctcgtaggccaggctgagtgaggcctctagccccacccttgaggaggcacactgagagggaggaccctgagactcgcttatgccgagaacaaaagtgtccaaagtacccgcgcagcatgactgtaaaccatcaggttccgggaaagtaggctgagcacaggaggccttatcaaagctcaggagctgatgcgctgaaggtgtgggaggtggacgcccatcagcctacaggtgagtgtggccaggaggggaggagccgtcttataccaggaagtggcctcagccaccttggacagtcaggacagcttgatgatgagagccaaaccatctcaaaaatgtccctgagggagagcgtaggagggaacagatcctctctccctgggcaggtcgggctctccaatggcctttgagttcctgcctccactaatcgctccaaagaatcattaccctgttcctgctcctccaggctacacatcaataaagcctgagccgtcaagccagccccaaccaagtgggcccaggggctgaccaagaaagagagggtggccaagaagcagggccgtgctggggcagtgtggtggtcaggaacaggtaacaaggtcacgtgcagtggtcctgctgcagattaggagctggagcctggaacctacaaatctcaatgctcagtcaccctccgctctgtgactgaggccagccaaagttctcttcttcaagaacagagttttcgcctcagcccaagatctgccaggaccctcagagattgattcagcctcacccgctcccaccataccattgtacagattatgaaactgagacctgccaagggacaggctgtgtccggtcctacagtgaacagccagtgacctcacccacaaaatcagcccagccatggccatgtggcctggttacctctgtcctcaaccttagagaggattttgccacacatatcaacatatacctacaacagtcttgtgaagtgacagattttgctagagatttgactctcaaagttgatttctggatttatttggttccatcatgtcacatttcacagaggtttttttttttcccttgatttttaaagattatagaaaatatgaaaaatatatataagatcaaaatcacctaaagattccccaaaaatcacccaaataaaaaatgtatgataaacatataacctatgtaaatggttatataatctataatttgtataccctacttctgtggcttaacctgatttcatgagaaatttcccatgtcactcactgtccattcctaagatagattctcagaagtgaaattagtggattgagaatgaacagatgctgttccagttaacccagccatcagcacgacatgaaggtgcctgtttccccatattcatgcccttctctggatattgtctctcgctcacctttgcaaatctgataggtgaaaatacgttgtcttcatttgtatttctgcttactggtaggttgaacagttttttccaaataattattaaccactggaagttcattgtcttatagagaattcacaggtgaaattctttcttcatttgtattgaagttctttcttcatttgtataaattttttctggcttttttattttttttttttgagatggagtctctctctgtcgcccaggctggagtccagtggcgtgatcttggctcactgaaacctccacctcctgggttccagcaattctcctgcctcagcctcccaagtagctgggactacaggcgtgtgtcactgtgcctaatttttgtattttttagtagagacgggggtttcaccatattggccaagctagtctcgaactcctgaccttataatccccctgccttggcctcccagagtgctgggattacaggcatgagccaccacgcccggcctttttttttttgagacagggtttcactctgtcgcccaggctacagtacagtggcgcaatcttggttcactgcagcctcagcctcccgagctcatgtgatcctcccacctcagcttcccaagtagctgggactacaggaatgctccaccatgccgggctaaggttttcattttttttgtagacagcgggggtctcactgtgttgtccaggctggtcctaaactcctgagctcaatcgtcccacctcagcttcccaaagtgctgggattacaggtgtgagccaccatgcctagcctttttttttttttttggagacagagtcttgctctgtcacccaagctggagtgcagtggtgtgatctcagctcactgcaacctccgcctcccaggttcaagtgattctcatgcctcagcctcccgagtagctgggattacaggtacctgccatcacatctggctaatttatttatatatatataaattttttagcagagatggggtttcatcatgttgaccagtctggtcttgaactcctgatctcaggtgattcacctgccttggcctctccaaagtgctgggattacaggtgtgagccaccatacctggcctgtaaattctttattgagaacgttaatccttagtttatcatttttgtgatgttttccccagtttgtcgtttctcttttgtctgtggtatttctgctgtgcctgtgtgtaattactgcatgggagattccatctatttcttccatgtatgtttctcgcttggtctcagtcctctcacaggacaggcctggggggagtagatatgcaagtcagaccactgagccattacagcgtgggcctggcagtgaatccatggggccgccagggaaaaattctgtgggctcagctctgaagaacctgcatcccagactgaaggatggatgagggatagaacgggatgacaatgggaaggagcttggacagtgctttcagaggcagggagcctgttgcttgagaatgtgagtcaaattctcaggactgcaggagctcagaggatgcacagatccctgggaactgaaatacagtggggttcctagagaaaaggaagctgagccttagaaactgggtataattataatcttgcatggattatctaatcttgcatagataaccatgtctttgcatggattctaaaccaaacacatccttaggttcaaatgtgactgtctcagggagagaagccttccctcagccctcccccagcctaggtgagtagtccctgcttcagatactcactcacagcaccctgatcggaagtctctgctcagcatctgtcacactgtgtctgtgtgccatgactgtgcatctccaggggctcacagactctgcctggtccttcattgaatcccctgagtccagtgctgagcatgcagcaggcgctcacgacaactccagggaggagctttcctgccttcagaccaggctcagccaccaaacccggccaactttcaagtctctttaaattaaaagccaactcctggccaggtgtagtggcttatgcctgtaagcccagcactttgggaggctgaggcaggtggatcacctgaggtcaggagttcaagaccagcctggccaacatggtgaaacccgatctctactaaaaatatataaattagctgggcatggtggcgggcatctgtaatcccagctactcaaggggctgaggcagcaaagtcgcttgaacccgggaggtggaggtttcagtgagccgagatcacaccattgcactccagtccagcctgggcgacgagagtgaaattctgtctaaaaaaaaaaaaaaaaaaaaaaaagccaactcctttacacatgatcaagaggatggttgcaagccattcctttctgtttgcccactgaagccagttcctcctgtctctctgctgataatgctcttggctcagagaccctgcctatggccaaaatgagtaaacctgccgcgctctcaaaacgatcttcagttcactttccactcaatagtggtgtcttctcccctgtagtgtttattttgacgaatgaaaataaagaaatgggagtagtgccacctgaagaagtacagggcagactggtcactgagcactcaccagcagaaccactcaggcaggggacacccagtgaccagctgggccctgacccagagggccaagaaggaggcttcaagagcacagggctcagcctggtcccccaccctgcaggcagccgctgtagactctactcacagactttttgtcgcgctaggtgttcatgccctgtgggttgtgaaccacatctcctcccgctctgtcccatccagtcccgtcccatccccatgccccagctgtggaattcatgtcaggagtcctggaagccataaaaaactacctaatttctgtcaggagaggtatggagcaggggagtggcagtgttttgacattaaaggaggtacaaaagattggaaatcctccgatgaggcccttcccctggctgagcatggtctgaaggcaggaaggcccctccctagagggcacaggaggtgtctgcctgctctccagccccatgcagcaaaaaatactccctgagcttttcacatcatgaggcaggtagggagctccccagcctgagaagctgccagagggcagggatggcaccagcacagggagatgtcaagaatggggagacagggcaggagaggagggggcaatgagtgggagcccagatacacaggagtctaggggcctcgtggtgcacctgacacaggcattctgctctgcacacctcccccaggctccaaatacccacaccaggcagtcactcccaagtctacctctgtaaccttgacacccacaccctcccgagcttcaccccctgccatctagacgtgtccatgcatgtaatctcagtagcggccccccaaacccacttcctccttggcatccaatgtctgtgaaaggctctgtctccccacagttacccaggccagaatactccactcattcttctcctcacctccacagccaatcaagccctcaggtcccccccaagataacccataaaaccatctcttttctcattcccactacaccacgcaagcccaggccacaatccttttcccagatgctggcaacagctccctgaccaaaactgcctccggctgtgcgggtacacactgcctctctcccacatgcacactgcccagagggccagctggggcccgggtctgatcctgccactctcctgctgatgctccttcttcacttcccgtcacttcttcagctggcctcccagaccttcctgctttccagcctcatcgcccgtcattccctcccctgcagtacagcccagcaccttcacttctatgccacagcagcccttcacacctgcgtgctttgcctgcatacctgcttacccttctcatgcttatctacctggggagttccggtcatctttcaagccccaggtgaaacgtcaccacctctgtgaagccttcctcagtttcccccagcagaggggctcatccctcttctgtggtccactgtcgcttcttgcaggctgctgccccagcacttaccacaccagagtgtgcttgtctgtttacacatctgtgtcccccagttgactctgagctccagcaagggcgtgtcccgtacatctctgtatccccagcatacagccagcacccagtgtttgctgaatgaatgaaggagagacagggaaaaagagataacaccccaaaagggagaagcagaggaaaaagcaaggcagtaagagtgagggggcgcagagaatgacacacccagcaggaaaggaggggacaggctggacaggagctgatggggtcccccacagcagggccctttcctccaggagctctggttcggtacctcaaggcactcagcccagggtggctgactgatcaaagaggaactcaggtgggaggtaggaggcccaagcaaagaataaagggtctgggcaggatggggtatttgggtgaaagcacaggctgggcccctcctgtctccagtgggctgcacacacctgggcgggccatgccctggcaacactcccccagccttcccagcccttcctaaccacagggcaaacctccctccagtactcatccaagcctctggcagtggccaagcctgtggctgatgctgaagcacaaatctcagccgggcctgcgtggtcacaggcagggccttccccacagctggggtggggtggtccccttgggcatctcctcctccaaggaggtgaccgcactctcccaagctgacttcttgtggaccctgtgggtcctgccaactcttctcaaggccaggccaaagacagctccacccttttgtgcagccagccaggacgctcagccccagcgagctccaagcagagacctgaaaacaccactgttctcttccaaacaaaaacacatcatggcaacaggccccgacagtacaaacccagaaaccagggaaatagccatccaaggacaggaagcttcgtggacatctgtcctggataaaacttcgcaaactggggctcaataggctggacctgggactcttccccccagtggctgctccagatcccccgacaaggtctcttcactccacctgcacttctcactcagctcacctcctacttcagggggaaaggacactctccttttaactctaaagtgtagccgctgggtgcacattagaatcacctgcagtgctttttttttttttttttttttttttaagagatggagtcttgctctgttgcccaggctggaacacagtggtgcaatcatagctcaccacagcctcaacttcctggggctcaagtgatcctcctgcctaagcctcccaaagtaggtgaaactacaggtgtatgccaccatgcccagctattttttaaaaaatttttttatagagataaggtcttgctctgttgcccaggctggtcctggcctcaagcaattctcccacctcggctttctaaagtgctcggattacaggcatgagccactgtgctcagcctgcagtcctttaaaaaaaaaaaaaaatgatgcctgagctctgtctcaaaccagttaaatcagaatatctgggaatagcatttaaataactatagatttcttaaattgttgttgaagtattatttacatatagaaaagcacatgttaagtaaatgtacaattcaatgcatttcacaaacgagtacacacctgggaaccaggcccccagaactacccgctgcttcctctggtttcactggccacaccctcctggccatggatagccatcatcctgacttccagcaccacagagtgcttttgctgcttttgggactttaaatgaacagaatcataccatacatactcgtgtatgtgtctgcttttactcagcaatgcatttgaaatatggatagaccacaatttatttattcgttttactactgatggacatttaggcagtttccagtttttgcctcttatgaaagtgctatgaaaattgtagtaccagtcttgtgcatgcaagtattcacttccgtgggtaaacacttaggattagaagctctaggtcataaggcaggtgtatgttcagcttctttttttctttttgagacagagtctcactctttcaccgaggttggagggcagtggcataatctcagctcactgcagcctcgacctcccaggttcaagagattctcatgtatcagccccctgagtagctgggattacaggcgtgtgccaacacgcccagctaattgttgtatttttagcagagacggggtttcaccatgttggccaggctggtcttgaacccctcacttcaagtgatccacccgcctcggcctcccaaagtgctgggattataggcgtgagccaccgcacctggccggctttagcttttaaaggctcccaggtgattgtaaacccccagccaactaagaaaccatgggaagaatcctgcccccacccctcctttctttgtggcttctctccaaggccaatccacctgcctgggctctgaaactggggtcctgaccctcctgagccttcttcaccctggccctcttgagtttcaggaacttccttgacaaggcagggaaccccactgtcaataagctttccttcatctgtttaaggcctgggggcccatttcctaggttgtaccacagaagtcacaagaccagcttttccaggtggcagaggccggctctgaaccacactgtgtccttcccgagagactccctatgtgctctcagggccacagtcctcacacacagtcagaaactgggtgacaagacctttcctgatggcaaactaggattctgtggagagaggcaggcttattatcatcaatgtgctgaaacttgaagataaaaggtaatttccttcttttgcaaaaataatgtcattattgctgtcttgcactttctttttttttttttttttttttttttgagatggagtcttgctctatcgcccaggctggagtgcagtggcgcaatctcggctcactgccagctctgcctctgggttcgtgccgttctcctgcctcagcctccggagtagctgggactacaggcgcccgccaccacgcccggctaattttttgtatttttagtagagaaggggtttcaccgtgttagccaggatggtcttgatctcctgaccttgtgatccgcccgcctcggcctcccaaagtgctgggattacagttgtgagccacccggcccggctgtcttgcactttcatagaagctgtacctccctttttattttctcagatgacattccatatctaggacaactgctttgtcctttccactgactggaggaggggagaaaaatccaataatcgagtctcatactgagtgtaagggggtgaggcttagtgagttggggtcccactcagctcccctggcagcgggctccagaggggcgggaactcaacctcatcacaatcccttcttccaggaagggttctgagaacacccaggccgggaacgggcttgctctcccatcactgcctgtagcagctttgagatgaaggggggatgtggagggccagaggcctatcttcccaagacctaccaagtgaccctggccacagccagcggaaccatggtgtgctccaggcccaggaaaagccatcacaagctgaccagcagcctctttagagtgaaaagatgagccggcctgtcagattcccttcctaaggaatcctaactgggaaatccgagatgtggaggtatgcagccaggagggaacaggcgagagagagccaggtaggtgcgagctgcagctacactagagctgaacctctgggtgcccccggagactggctctagagcgagggaagagggggcaggaggcagagagaagcagggggccatgggccaggcctccagtctaggagagcacgaactggctcccctaagatgcccattaactcctgcatttgtgtctccacaaaatggcaaacagagaaaaaaattatcccctctgtgacctgcagatcgtcagggctactgtgaggatctgcaagaggtcttgactcagtctggggtggggctggggacacccataaccctgcccattgagcaggacgtccccgactagcactggtgagcgctgtgttagcctctgtcccatcacatccttgaaggatacctagaggggcatctacccacggcaagtgaagacaggggtaccactgggcctcaaaggcacccagaaagctccatacatgtcctccatgcctgaatctttccactgggactacagtccaaggaaccagccgcggcaaggccctctctacacctgggccacacccagtgactgcctcccaccaccatgggctcggaggcacgacccaacttcagctcaggcccagcctccctttcttctcctccctccaccagaggttagaggccagcaattgctgccccctcctgcccagagctcaaaggcctgtgcagtgagaacagtcgccacggagacagacagggacaaacagctaaaaccgggaagctttcctcctggggatatccaggatttcctacaaagcataggccaaatcacagagccggctctgcagagagtgccctgccggctgctggcttcgtcccatcatgcccgctgctggagcggcatctatttgagctggcacccccgggtctgctcatagaccactttttcttggcaggccacttggggcttggccatttccagacaaaaagctggtcattcaggtctaaaaacagacttgcattcattaaggaacagagcgcccctgtgctcttgggggccgccctccggccaggcctgctaagtgagggggcctgcagacaggctgagccgctcagacgcccccactcagggctgccaggggctgtggctactctggagacaagtcagttctgtccatccatggatactgtccagacagcccaccccaaccaccctgggatacccacctcagaattactctggctttgtggatccatcaggctcttctcaggaccacaggcaagtgtgaagggtcttggggtcctgaaagagcctggagttggggacaggaagacaggaatgcaggcctggaactgcttctcactgctgaggggctttgagtaagccactcttcctttctgggcctcagtgactcctctgcaaaggggcgagaaagtcacagcccaggagggacaacaaatgttgtctgagggaaaaaagcagaggccacgaactgtataaactgcagatggccactggccctctgaggtcagatgaaccctcatcccaggagggacctctattagggcatcctgactcaaccatggagggcaaggaagacttttctgaagacgtacaacattggagctcatctccaagggatgctagccaaatggagaagggggattctgggcggacagggtcactgtagaggggttgccatatacaaaggccccaaggccagaagtgtgcagcatgtgtgagaaagctaaatagagcctttgagtctggagggcagaggtgagcagcgaagtggtaaacaacaaggctggaggggttggcagggccagatcatgcagggcccatgggcctctataatggttttggtcattatcttaaaagcaatggggaaccaatgtagagatttaaacaggaaagtatactatcaactttgtgtgttaataatttgtttccaagtaatcccatggaagtggggcaggggagtggagggtgaatattggtgaaacaggaatgactcgtgttgttggttattgtagctgggtgatacatacgtggggatccactggacaactctctcatcctttgttatgttcacaattttccatggagagagatcaggtgaaaggctgtagctcagcagagagatgatgtcttggactgggtggcagtggtgatggagggccagggatggatttggaatatgtatttccaaatataatcaatctgacatggtgatgaattggatgagaggtaaaaacaagaaggtgtcaagtatgactccagatttctggcttaagcgagtaggatagtgggctcttttgctgagactaaatgaggtaaaaatggactagaagaaaagcctagttggaagcaacagtcacgagttcagccttgaacatgtgtgagagacatttaagtggagatgtcaaactatatatgactaagaagctcagaagaaaggtttaggcaggagggataaatttctgagttactggcccataagtgagaagaggagctagtaagactgtgccagggaaagtgggtacacaaggaacagaagctatcaacaagaatgccaagacttagggggaaataaaagtcttttcaacaaatcatgctgggacaaactgaatatccacatggaaaagaataacatgacctttagctcacactgtatacaaaaattagccaaaattcggccaggcgcagtggctcatgcctgtaatcccaacactttgggaggccgaggagggtggatcacttgaggtcaggagtttgagactagcctggccaacatggtgaaaccctgtctctactaaaaatacaaaaatcagctgggcgtggtggcgcatgtctataatcccagctactcaggaggctgaggcaagagaattgtttgagcccgggaggtggaggttgcagtgagccaagatcttgccactgtactccagcctgggcgacagagtgagactgtctcaaaaaaaaaaaaaaaaaaaaaaacccaaaatttgctaaaactatgaaactcttaaagaaaacataagtgtaaatctttatgacctatcaggcaatgatctcttagatatgacaccgaaagcataagaaacagaagaaaaaaacagataaattggatctcatcaaaattagaaatgtttatgctgttaatatcatcaagaaagtgaaaagacaatccacagaatgggagagaatatttgcaaatcatctgtctgataaggatttagtatcccaaatatatagagaacccttataatcttgaggacattatgttaagtgaaataagacagtcacaaaaacacaaacacatatgaatccacttaaattgggtatctagagtagttgaattcatagaaacaaagtagaatggtggttgccagggcctgggggcagaggggataatgagttgttgttctttgggtatagagtttcagttttgcaagaagaaaagttctgaagattgcacaacaacgtgaatatacttaacactactgaactgtgcactctgttgcccaggttagagtacagtggcgcaatcatggctcgctgcagcctcaacctccctgggcttaggtgatcctcccacctcagcctcctgagtagctggcactacaagcacatgccaccatgcccagctaattttggtattttatgtagagacagggtctctctatgttatccaggctggtctcaaacttctggcctcaagggatccttctgcctcagcctcccaaagtgttgggattacaggtgtgagccactgtgcccagatggtagggttttgttgtttttttttttcttaactacaatttaaaactgttctaaaagaactcttggccgggcgcggtggctcacgcctgtaatcccagcactttgggagccgaggtgggcagatcacatggtcaggagatggagaccagcctggccaatagggtgaaatcccatctctactaaaaatacaaaaattagccagacatggcgatatgtgcctgtcgtcccagctactcaggaagctgaggcaggagaatggcgtgaacacgggaggtggagcttgcagtgagctgagatcgcgccactgcactccagcctgggcgacagagcgagaccatgtctccattaaaaacaacaacaacaacaacaacaacaaacccgggcatggtggctcacgcctgtaatcccagcagtttgggaggccgaggcaggtgaatcacctgagatcggcagtttgagaccagcctggccaacatggtgaaatcctgtctctactaaaaaaaataaataaatacaaaacaacaaaaagtagaaaaccaggtgtaaggctgtcatggaagccaaaggagggtttcaaaagatggaggagaacgcaatgctgaagtctgctgaaaggccaagtaagagcaggacgcaaaggcagtccctgaatttaacactgcagatgagttactttggtcaggacaactttggtgcagtagtggggtctgctcctcctccttttctcctgggccggtgactgcatcccagggatggatggtgaggacaggtctctgtccaccagcaaggatgctgctgagcacagctggaaactcagtcccagtccagctcagcgccacatcccctctgaacctgccctccgccctccctcgcgggaaaagaccacggagatactgggaacggatagataggattgcatctttctctcctggttccccgagggggttgtttgcagtcggggagggagagggactgccctcgccccacggcctcactgccctgttccccagttccccaagccaccttcacctgcagcacctccacccctcggctagcacaggcaagagccacaagcctattttctgcgcctgccttggaaagggctgggaagctggtgaggcagccgcacccagcattccacagccacactcagtggctccaaagcggcgcccgcggcggcactgatcccgcccggctggccccagctgaccctttgcaggaggctggtggtcacagccagagcttgcgcaggccggggagctgccaggagtgccgcagccgtgcccccacctgctgggctcccgggaaaaggagcgcgcgcccctctgagccccttcctggtgcagtgcgtgtaccaagcgtggtaactggcctggctgaggacgcccgcgtggggacgggctgcgcgccctgcccaggctcctgccaactcggctcccccaggctgggctcggccgagggctcagattcctgaccaatgacctcgtcttgaggagcttgctaggtcctgggacctcctcctccagggagaaccccagattgtctaactgcgggaacgctccttaggaatgcctgctctcgccactgttattcaaccttgtcctggaggttccagccaccgcacacaggagagaaaaacaaataaaaggttcacttacatgttaaagagggacaattattgtttgaagatggtcagataaactacctaaacaacacataatcaaccgacaaatcataaaaacgtggcgcagatattttcatatttgggcaccaaagtaggcagaactgtgatggggtagacacataattaactcatggaattaattactactttaacggttacaagatcaatagatcttgtccaataaatggtattggggcaattggctacctcccaaacgactgattttttaacttgtaaaaatcaatcgttttcctgtagacctacaatacagttataaagtatatgtgggaaaatacctatattcatatgacaacaaaaatatattttgttccagttttttttttttttttttttttgagacggagtcttgctctgttgcccaggctagagtgcaatggcaccatctcggctcactgcaacctctacctcccaggttcaagcaattctcctgcctcagcctcctgagtagctaggactacaggcacgtgccaccatacctggctaatttttgtatttttaatagagacaggatttcaccatgttggccaggcaggtcttcaactcccaacctcaggtgatccacctgcctcagcctcccaaagtgctgggattacaggcataagccaccattcctggcctgagtcaaagttttaaaggagcaaatttaccccaaattaatttgtaaatgttccaacagggtgcacgtgcatgtgcacacatgtgaaagagagcaagaaaattttgaaaaagaaaatgatgtaaaggctttgccttaccagatgtcagaacaaattacaaaggtaggataattaagtagcgaagtattaactggcctaggaaagattactagatcaatggagcataagacagtccagaaaatgacctatgagtatatgagaatttagtatagcatgaagaatgtgtttcacacaagtaaggaaagaatgagttgtccaataaatgatattggggcaatttggctacctcccaccattcacaaaaagataacccagggagataaaacacctaaatattttctaaatctataaatagctagaataaaagagaatatttttaaatatcaggaaaagtttttctaagcaagatataaaacccagaacacataaaagatttaattgcataaagatttaaaacttctgtatatcaaaatttaagtggacaaaggattggtattcttcatatgtagggagctcatccaagtcaataaaaataggtaaataacctaatagaaaagtgagcaaagaatatgaacaagcaatttagaaaacaatctatcttacctattttatcagtaaacactaaaattatagtgctcagtattaccaaggatgtgaaaaatagtcattcattattccccattataagactaaagactgagttaacctttctaatatacatcaaatgccttaagaaatacaaattcttttctttttcttttatttatttatttaattttttttttttttgagacagagtctcgctctatcacccaggctggagtacagtggcgccatctcggctcactgcaacctccacctcctgggttcaagcgattctcccgcctcagcctcccgagtagctgggactacagaagcatgccaccacgcccggataatttttgtatttttagtagagacagggtttcactgtgttagccaggttggtctcaatctcctgacctcgtgatctgtctgccttggcctcccaaagtgctgggattacgggcgtgagccactgtgcccagccaagaaatacaaattctttaacccaacaattccctttaagacacttgatgtaaggaaataaatggacaaaaatgtatattcgtatgattaacaattatggggaaaaatgtagaaataccataatggtattttatcagtataatggattcctatgcaattgataaaaaagagtaagttagagctcctatatgtgctaatatggaaaaaaagtccaacatgtattgtaactgataagtaggtacagactgaatgcagtggctcatgtctgtaataccagcactttgagaagccgagacaggtggatcacctgagctcaggagttcgagaccagcctggccaacatagtgaaaccccatctctactaataaaaatacaaaaaaaaaaaaaaaattagctgggtgtggtggtaggctcctgtgatcccagctacttgggagactgaggcaggaaaatcacttgaaccccagaggtagaggtagagtgagctgagatagcgccactgcattccagcctgggcaacaagagcaaaactctgtctcaaaagaaaaaaaaaagaaaagaaaagtagatacagatcagtatgatataatctataacataaaaaaactatacttaagggtatatatcaatcatgactacatccaggagaataaagggatgatgttcactctttatacactgttttgtttgaacttatactaacaggtataagttcccatctgctacttgggaggctgaggtgggaggatcacttgagcctgggatgttgaggctgcagtgaactatgatcatgtcactgcactccagcctgggcaacagagcaagaccctgtctcaaaaaagaaaaaacaaaaaagaaaactaaaaaaaaaacaacagtaaattaaagatataagttatatatatattttgagacagggtatcactctgttacccaggctggagtgcagtggtgtgatataaactcactacaacctctgcctgctgggctcaagcaattctcccactcagcctccaaagtagctgggactgcaggcatgtgccatcaagcctggctactttttgcattttttatagaaacagggttcttgccatgttggccaggctagtctcaaattcctgggctcaagtgatctgccagcctcagccagcctctgaaagtgctgggattacaggtgtgagtgagtcactgtacctggccataatatctttttttcctaactttttagattttaaaggcttaaagttaatactatctaatgttgatcaacatattgtgaatgaacagtctcacatacttgtatgttacgacagtatgaaaaaggtacataaattttatgtgtagacacctgtcacacctgtaaattccatttctaacaatttattgctaggaaataattgagcacaaattacaatgtataataagaatgctcactggctgggcgtggtggctcatggctgtaatcctagcactttgggaggccaaagcaggcagatcacgaggttaggagttctagaccagcctgaccaatgtggtgaaaccccatctctactaaaaatacaaaaattagctgggtatggtagcatgcagctgtaatcccagctactcaggaggctaaggcaggagaatcacttgaacccaggaggcggaaattacagtgagctgagatcctcctactgcactccagcctgggcaacagagctagacttcgtctcaaagaaaaaaaaaaaaaaagaatgctcattaaagtgtagttagaggagaaaaaaaggaagtactataaatgtccatcaataaggcacaaattatgttttatttgtagactggaaggctatgtaaccattaaaaatatttatcaatatttattaaaacttattaaaaagtctatattaacatgaaagatagcattatataacattggaaaagcgttctgtagaacagtgtgcctaataatatatgtagaaagatgctcactaaaattctaacattttcctccacgaattgggatttttacatgtttttttgttttctttatacttttctgtatttttggtatactttgcctcaatttttttttttgagacagagtcttgctctgtcgcccaaggtggagtgcagtggcatgatcttggctcactgcaacctccgacccccaggttcaagtgattctcctgcctcagcctcccaagtagctgggattacaggtgcccgccacctcagccagctaaatttttgtatatttagtagagatggagttttgccatgttggccaggctggtctcgaactgttgacctcaggtgatctgcccacctcagctcctgaagtgctgggattacaggtgtgggccaccatgcccagcctttaagagctttattggttttgatcttaaaagtattatacacctgttagaataagttcaaacaaaacaaagtattcaggccactttgcctgaattttataattagaataaacatactattttcatttagtaaaagaatttttaaaaaggaggagaaggagaaggcaggaaaaagaattgttccaaaggcactgcgatattattaatgaatagacacctctgaaattcaaaattcctaaaatctcattcttcactacatggaaactttcagaaccaacagaaaaataaagctttgttttaaaaatgaactttgccaaatctacatgtgataaaaatcacacaagactaaatataggtccacacacatgcagagacacaaatgagtgcatgtaaaactagtgaaatctgactaaggtagatggattatatcaatgtcaattttctggttgtgatactgttctattgctattcaggatgttaccattgggggaaactgggtgaagaatacatgagatctctctgtggtattttataaaattgaatgtgaatttacaattctctcaaaacaaaaagtgtattttaaaaagtgaactttgtgcctggaaaagtaaaacagaggtagcttttcttagagctgtagctgaattatcactaagaagtcccattttaggttctcaaagttagaggcactgaaaggaaagtacgttttagtgagcacctactgtgtactaggccattacacagccagagtacctatgaagcaggttagatgtgagtctgttttatagaatgataacgggaggctcagagccagtagaaactcagcagtaacttgtggagcaagaatttgaacccaggtctgtctgaaagcttaggctgtcctattgactacatggctggaatggcttaaaagacaaaaccaaaccaaacccttactcagtgttatccatatcaagaaactccatataaagaaataaatattcgagtgggtggggaaaaaaaggtgcattgtaactaggcaacaggaatttcaaaatgtatgcctatacatgaatatcatctattagatctgtcactgcagtcctgactattagaaagttctaatagtcaattagctgggcgtggtggctcacgcctgtaatcccagcactttgggaggccaaggcgggaggatcacaaggtcaggagatcgagaccatcctggctaacatggtgaaaccccgtgtctactaaaaaaaatacaaaaaaatagccgggcgtggtggcaggcgcctgtagtcgcagctactcaggaggctgaggcaggagaatggtgtgaacctgggaggcggagcttgcagtgagccgagattgcaccactgcactccagcctgggcgacagagtgagattctgtctaaaaaaaaaaaggttcttcccaatacctaaatggaccaccttctagctaataatccttcaccaaggaacaaacctttgtcctcatgttccttccttaataaaactggatctccactgctggtgtgaccagggcaaagtctgctccacaactctctgttctcttgtgtcttcttatattgcaagattcattaacttttccagtttctgttttcacatggggacacttggttatttcccattctcccaagtcttccatcattatggacgcagattgacaatctaatgtaaattacatgcctctgaggtccaggcaagagttggagggtggatctgtgaactcctggaactttgggcaaaattgttgggtctgaacaaaggagtatgtttctgggaagagagcatttcacttttattagactctcaacgtagcctatgacccccaaatgatagaaaatactcctctaattaagcagctccttggggaaatggctgattccggatctgaggaaatgcaaaaaggagcctaaaacatctaatcataccagaaactaaagaagtcattgaagcctggagtcatggctcaagaactcaggaaccaacttaaagatgggaccatttgagcatcaataagaatggattaaaacacatcaaatatgtttaaatccatgagattataatacaccgaaatgactcattggccacctttggtggctactagagcccataccacgattttgaaaactaagaaataagagtcaagtatttattctgcctttctagtactggctacacctcaggataagcaaatggttgaagagggaacacatcttttttttttttaaatggagtttcactcttgttgcccaggctggagtgcaatggtgtgatctcagctcaatgcaacctccgcctcccgagttcaagcgattctcctgcctcaacctcctgagtagctgggattacaggtgcccgccaccatgcccagctaatttttgtattttttttagtagagacagggtttcaccatgttggccaggctggtctcaaactcctgacctcaggtgatccgcctgccttggcctcccaaagtgctgggattacaggcaggacccaccgtgcccagctgggaacacatctttttatagaaagagtctcctaataaatgatgaaaaactggtaggattagactaataccatatttcagtccctaattaaataatgggtctgcatgaaataatcatcaatggctgctaacattcttcaaagagaaataactgatattatatacttcttgaagcacacaataccatcagaatctgaccgagactgtaggtccaactcccaatgtataggaaatacataaatcaaaggaatggtttaaacaacatcaacacatcagaaaaagttatagaaaacatagcctgtttttttcaacaaataatttgcaaggaaaaaagaaaaggaagaaaagaggaaaccatagactaaagagataaagatatagagattcaaaatggcaactctttgactttagtcaaagtataaacttcatttgaatccttattaaatggtacaaagacatttatgagacaatggagggaatgtaaatgctgactagctatctgattaagaagttactgccattttttagatgtaataatgatattgtagaaatattttttaaaggctcttttatagatatacattgaaatatttttggataaaataatataatagctacaatttgcttcagaataatccaggagacagggagaagggaggtatatatgaaacaaactttacccatgacttgattattgctaaaaccaggagatgggtacatgccacttattatactattctctctccttttgtatatgtttgaaattttccacaataaaaagttagcaattcagaatataaacatgtttcaacttgtctggtaatgaaggaagcccaataggaataccaattctgaagtactgtcactgggttattttaaaataaaatttctaagtaatccttcaaaaattcaaaatgtattttaaaatagcattttgtgtggcctgagtgattactggcaggttttgagtaatctgattaattctaacacatattagaaatatctaaacttttttcctacagaagagagaaaaaaaatcctaataatcagtcacagttgtttggtcaggcatactgcccacgctgctgtgcggtgggtaaggcaatgaaatgaaataccagcaggatctcgacaattaactactataccattgatgtgccatgtacagatgttaggaggaaaagcaattcatgtttgatttaaactaattcttcaagtgatctttactttaggttaaaaagaaatagagccagccaaaaactgcttaaaaattaacaatgtaattacaaacatcactgaggaaacactaatttatgacaaggctttaaagattggttcagtcggccaggtgcagtggctaatgcctgtaatcccagcactttgggaggccaaggtgggcggatcacctgaggtcaggagttcaagaccagtctgaccaacatgcagaaaccccatctctactaaaaatacaaaaaattagtcgggcgtggtggcacatgactgtaatcccagctactcggaaggctgaggcaggagaatcgcttgaacctgggaggcggagtttgcagtgagctgatatcgtgccattgcactctagcctgggcaacaagagtgacagttcgtctcaaaaataaataaataaatagataaataaataaataaataaagattggttcagtcgccacaggttattaaaacacgcctccagtcctaaatgatgaccaatcatttcttttttttttttcattcttgttgcccaggctggagtgcaaatggtgtgatcttggctcactgcaacctctgcctcccgggttcaagcgattttcctgcctcagcctccctagtagctgaaattacaggtgcccgccaccacgcccagcaaattttttgtatttttagtagagacagggtttcactatgttggccaggctggcctcaaactcctgacctcaggcgatccacccgcctcagccccccaaagtgctgggattacaggcgtgagccaccacacccggcttgtgcatttcttttttttttttcgagacgcagtcttgctctgtcgcccaggctggagtacagtggcgtgatctctgctcactgcaagctccgcctcccaggttcacgccagtctcctgccacagcctcccgagtagctgggactacaggcgcccaccaccatgcctggctaattttttttctgtatttttagtagagatggggtttcgccctgttagccaggatggtctcgatctcctgacctcgtgatccgcccgcctcagcctcccaaagtgctgggattacaggtgtgagccaacgcgccaggccgtgcatttctaaactaataaaaatgtatagtagtgggaaggaggggcgaggaatcactttctcctacagtggcttatatccctgagaacaatgcctgtcttttggaatctgtgccggagcacgcaggtgcacctcagggaggctgttacttcttaattacacaggaagctccattcccaggggcttctgccctccccctcctccttcctttcccacattagcaaataactggggaattaaagcttcaaaggttggtgatgacaggtggtgacagactgatgccctgaagtccaggtgaatagcgcacagtggccaaggccgacctcaagtgaaactcacacttgcatcagagatggctgcagaattgagggaaatcattttcactttcctggaagggagaaaaattattttctggtgttcaggctcacaccagatgtcagagtggaatgctacaccgttcttgacttcaagggctttccatgggtagccacagcaaaggagaaattctgaaaataaatgaaacatcttccgaaactgggaaggaaattggagggattttggggggacggggaataagttttattttattctttctcctaagcttatgattttagtattccaagaccttatgcttgaattacttagcaagagggcatgcttatgcagaagacagggaaatgaagagaaaacagcaggcatatacaaaagtgaaggttccttaacagagttcatggtggagatagtaggcaccagtggagtttttatccagaacttaaaacttaggaaatacctatgatgacgctttagctggaagtaatggagatatctgattccaaactcatattttttctttattatttattattattattattattttgagacagagtctcactctgtcgcccgggctggaatgcagttgcgtgatctcagctcactacagcctctgcctcccaggttccagagattctccagcctcaacctcccaggtagctgggattacaggcacacaccaccacacctaactcatttttgtatttttagtagagatggggttttaccatgttggccaggctggtcttgaactcctgacctcaggggatccacctgtctcagcctcccaaagtgctgggattagaggtgtgagccgccgcgcccggctcaaattcatactttaaatgcctatttgcaatcagcaaagagccaggtatgctgcatgctgcttgctgtaaggatttggcttcactggcccaaattttttcactccaccaaaagataaggcacaggcccacttgtccaatcacatttgctgaaaatactgtagcatgagtgtagacaaacttcccctgaagctgctagaagtgtctagttaggagaatcactggatgactgcatgcagaaggcctttagggaacctacagtccaatctccttaccttatggtgtaaagcaggcccagaaagcggaagtgacttgtcccaagtcgcagcaaaacaggaacagcctgaggcttagaactcacttctgattccagagtgaggctcttccctccagctgataaacatggtccgtggcaggcaaggaccagagcgaacctaagcaggttaggggcggggtggagccacccaggaggcactaacagcgcagcagctcatgggagagcttccaagaggccagctggcagcaacccaccttgggtactgccgacctcaacctcagggggtcacgggagcaccctaggtggatgaattagcatacaagtctctctggtctgtgccaaagctttggggccttgctaaatttagaaatttgaggccaggtgcagtggctcacacctgtaatcccagcactttgagaggctgaggtgagcagctcacctgaggtcgagagttggagaccagcctgaccaacatggagaaaccccgtctctactaaaaaatacaaaattagccgggtgtggtggcgcatgcctgtaatcccacctactcgggaggctgaggcaggagaatcacttgaacccaggaggcggagactgcagtgagccgagatcacgccattgcactccagcctgggtaacaagagcaaaactccgtctcaaaaaaaaagaaagaaatttgaaagcagccagcaacatcaaggcacagatggagcttgagctaccctcttcaggctattcagaaaattctcccaaggggaagttgggaaggagaacttctatttggccccagcctaaactctcctggaagctcgatggggcctctgtcagctttcccctctggacctgcccatttgtcccagaggtgcccactgaggctacctcaatgcctgtcaaactaaaacttaaacctaagagtgtctgcagcatggtctccagccagcctgatcagaagactatggagggggccaggcacgtggctcacacctgtagtccctgtaatgctagcactttgggaggctgaggtgggtggatcacctgaggtcaggagttcaagaccagcctggccaacatggtgaaaccccatctctactaaaaatacaaaaattagctgggcgtggtggtgggcacctgtaatcccagctactcgggaggctgaggcaggaggatcacttgaacctgggaggcagaggttgcagtgagccaagatcccaccacggcactccagcctgggtgacagagtgaaactgtctcagaaaaaaaaaaaagaaaaaagaaggaggggcatactgactcctcactgaagaatgggatagacaccctctattctacctctcccagcaaggccataagtctttgctctgaaaggagccagactttagagccggctacaggtggacatggggtgaagacatcaggttgcgagggtaccctctctcgttccctaggagcctggcccctgcaaggaggggcacctttaaacaatcaagcatagtgagtggggcggcaagcagagcagagacacagacgacagcggggtggagccccaccagtccctctgagtataaggcagagggagtcccgctggggtccacatccctgtgtgtctcgggctgatttggacacaaggctcacacattcatcctacctgccccagtgctagctggccgaggatgccaggctgtacccgaccttaggctgtgcggcttggaacctggaccggggcaggaattgacaggttcccccaaacaatgtcactcccaggaccctaagacctcaagcagcagaaaccacaattctggatgttacgtgcagcgccagctcctgtctgccctgcctccttatccctttctcccagggcgactttggaccaggtctcgaggccgggagaccggccccagcccgcccgaccgggatgggcctggcgcccgggggaggccgcgtcgtgctgagacagctccgagctgcctccccgcagccgcgggccgctacaatacggattcggcggcgagaggaaacagtctggccctccaggggacgcagggaaatccaacctttgggtcgggggcaattaggactgggagtcgataccgcgggcaacgaatgatgaatgaataaatgaaaggatgaacagagtggcgaggcggagatgggccatgcggggcgtcccgaggagggtgcccttccttgccccgatgctgccgggaccgtccctcatcccccaggtcgcagcagactcagccaagacacccggtcctagtgcgaacacctcgcgggccccgggagacgcctgggcgcgcggtgcagctctggcccggagcccgcattccggcggccgggaagtgcctgccccgtgggcagaacgcgccgagttgccgcggccccaggagccgtcctgccccgcgcggcagcagcccctcgcggcggcctccggaacccccgagaccggcccccgggccgcaaccccttacccgccctcctcggtggcctcgctccggcttaaagcggtcatcccggcgcctgcacccagcgccccgaccgcgcgccgggacccagcgcccgccggaccccgcccgccccgtcgagagcccgccccgcccgcccgcccattggcgggtcgcgcgggccgggcacagcccattggccgttcctccccctcattccccagcttccccagcttctctccttccccaccttccccaggtggggctccaagctctgagcagatcctagcgctcggttccccggactgggaggtcccggaggccagggcctggcgcggcacctcctgtccctcacgtcgagggtattgtgtcccctctggacgcttctgtcgtcctagtcttgcggcttgggtccctctgcaggaaccaattccggcccctctccaacctaacccttcccaacatagagctccggataagtttcaattttaccgtcagtggggaacaccaaaggggatattgaacaccatggtctgacagccaagtcaccaccacgaacccgggagccaggatgctcccacgcacttttgccggagttaacattgcagtttctccaaggaaatacacttttggaggagtctgcaaaggggctgaaggtggacacaaatcaaaggcagggaagcagaggcacgtgcgctcagtgtgacaatgagcttttgcctggcctgcaggccctttcctcttccatccccaccaggacacttggtccttgggagtgtggtcaggggagaggaaaagcgcaggccagatttggtcccattcccaactctctcccccagccctttggcactacagcatcatggtgggagggcaccagcaaacaggaggggtcccaaggggagcctaggtccacaactgaggacctgggagccaaacccagtctcaggcgcccagagctgactcctcctacagcccccataagggatacgctaatgcaggaagaccaaagtggaagaaccatggccaaggccactttgcaatttgggtttatctaccagagtgggagggaggccttgtccctgctctttcccatcttcggttcacgtaagccattaaagtctccccgcagcactgaagggggcaacctgtaaccctaagatagtaagctactgctttcccagcgcctctgcaccaggaggtgggcaggatggcaggtgacaccaccatagctcccactgcggggcacgaggctgcagccattcccagcctgctcagagggcagggttcaaccacctccccctccccagcagaaaagagaggaaacaggtgcttcagctgttgtttattgacatacaggtaggctctatagcaacaggcctggaggtgctgcagtagtgggggaaaatggaaggtggagggtggagtgtttgctgcaggacagctgagtggagggtggggacaggtgcaaactggagaggcctagagagctagagaagcaagtaagggccagggccagagtcggcttcaatggaacaacagcccagtgccctaaggcccctaactcttgctggctgtttcttgaccccaagccagggttgggagtcctctgggcatccattttttctaaaggaactggacagagtacacacaggaaaggaagctgtcaccctcttgccatctggctccaggggcctccagtccagcattcctccttcttcccttgattgggtggggccacatgatgggcagccaggctctgggctgtcccactagagcaggctgcaaacacagccatgtttcagtgaggcgttgatcttcttccctggtgtcccaacctaccagtgccacgttacagcccagagtgagttctacaagcgttgctggcctaatggatgggctgggggaagggggtgggacaggggctggaggaggggctctggggtccatcacggcacaggaacaacacgcatggtgttggtgaagccggagccagggcgccatccggtcagcacaatgaccacatctcccttcttgaagaagcctcgggccttgcctggaggaagagaagggaggttggtgagtaaaagccaagccaggcaggtttgcacctgggcagctgccccatagcctgagtactgaactaggctggctgaccactacttcctcacaccacaaggtggcaccaaactcacagcccaggcaaacaggaggaaggccctgaaatgtccttatcactcagatggcagggttggcagggacctttggacatcattcactatcctggagagggtgcaaagccttgcccagggtcagagctagctgcttcctgtcatctgatgataccctaccttatacagggacaatggccacatcagtacgtaatctgtgtatgccaccccacagcacaggagctgtggccaattttatttaaaaaaaaaacaaaaaacaaaaaaaactctcagtaatgagcagatgccaaaaaatggacaattttgctttgagccccagactagaagagaagaggaactgaattgctcagccctacaactcaaaggacccttttccctcctggctcagcttaggacttcggagaatgagagattcagaatgaacattcccaataagggagaggaacagtcgctgggccttttgccccactaaggtctgtgtgttcccctttctattccccaaactttcggggtcccacagaagccaatgctcaagcatccccaagctcctctaggctctagcccctgctccagccacgtaccaacattcatggcaaagttcacccggaggtccacgtcctcagcccaggcctcctggactgggtccttgcacagcacagggaagatgccacggtacaggtgggcctgacgagctgtctggggattccgggtcacagcaatgatgggggcacgtgggcggtatctggccacctggtgagcagacctgagatgggatgggggacatacagaagagaccattacacgaggccccaggaagtaccctcagggcgttcaaacagctcaccctctcatccagctcactgagggctctggcctcttcaacatctgctccctaggacccctcccgaggctcgggcagcccctcatcctatatcccccacagcatgctaggttaccatttgccctctacccccattccacaggccaagggctcaggatcaccttgacccagcaagatcagcctcacccacttaccccacacagcccatggttggcagaacccctcctacaccctgaactctgacacagagaggcagccctggcccaatgtcaccagcacccattcctctcgctgccaatgacagtgacaagccaagcagcacgtgactagcacctgactcttgacatctgcaaggagcagtagcagagctgaccagccccctgggaatcaacatcaggcttctctacttttgtgccctctccctgccccacatggcccctagctcctgaaacagtcccagcaactgggctataaaggcccagaatcaaatctgagtatctagatgaggcttagaaatctaggtgctactcagcaggcaagaacaggaaatgggagtgttgctgcaggagcagctctgcctgccaaagctcctttggaaggcaggggacccttctaaagcccctctgccaggcactttcttgaacactgacactgcacacttgtagctgcagctgtgtctcaggagctggggaggggcaccagaagggaagttatgaggacactcaacaggtgtcagggaaacttaagccacatcacagcagagaagtccctgcacttcacgcttggcctctatgcaaggccttcagagggaagcaattgctgaagccaggaccagctgagtgaaaccccagaagactagagcttaaaatagccaaacagcaagaactggaccttttaagaaaggtcaaccctacgggttggagctgttcagccaagagtgggaggctggagccctctgctgagggcatctgcacagagcttgtgtcctggttctctgggctgcccacgcccatctgctgctcctcagtgcatgggcactgcctgtttgctcccctcttccaggaaacccttgctgccctgtggacagggacaaggagcatactccctaactaggagagtgaaggacattaactcaatgtcctgggccaaggaagggatcccaagttggaggcccagcataggccacacagtcctcagcctggctgccaggccccacagaatgtcagccaagatagcacagcaacctctcctgagctggaacccaatttgtctttagggctcaaaaacagcagggactagtgtgccaaatggaggcacagtaaacagcatttaaataaattcatttcccaactgaaatttttaaagagcacatagtaactggaataagcaaaagtggttatcttttacaattttagaggactaaattttcaatatcaaataaccatttgtagtcagcctgtgcactgttatgtaataaatctccagcataaatttgcttttgatccaaatgttctgacattccttatgagtgctacctagagtcctttgggcccagggaaggggctctgctcaatccttccctgcaggcccaaggtggcaggcagaggggtcttaccttggctcagtgccacctgagcattgttcaatggactgctcccaggacccccaaggtgaggtaccactgagcagggcattccagggagccgctgccgcctcctacctgccagacttggtgaggacgattatggccccactgcagcacttgaaggaggcctccacggcacccacggcggtggcttctgtggggtcgctggtaatgggcgccaggcggcggagttcctcaaataattgcaagtggtagatggcagcctctgcctcacgggcaatctaggggagcaacatccgtccagagggacgagagggggacagagctttgtcagagctttgtcacaaaaggagagggaggggaagagtcaccggacagctggtgaggaacatgttcctgggaacaaaggccaagaggagcccaatcactggagattctgagctgagccaagatcaagactccacagaaaccagtccttcaccaagtgcctgtgacatctactgtgcctactgagccacaggaccctttggtcctgccctgccatgacctccctggcggtgttcctacagacgagaagaggctctgtgcccagatgccaggttgggcctggctgtcttctcctagagcaggtggagcaagaggctggttatcctaacagtgttacctgcccttagggccctacctgccagactccgtcagaactatcaaagctgctgctaaacacttataagaagcctccacgctgcccatggccatggcttccatgaggtctgtggagtgacttgaggctcgcacaagttcttcaaacagcttgcggtggaacatggctgcctcagcctcacgagctatctgtaaggtttaggggaagagggggcaaggaagagggaaggaggaggaaaaaaacgagacacaacacatgggaagacagaatggggaatttatcagagaggaaggtaaccttaggttaattggctaaatctgtccttcaggcagatgcagaggtagggtgatgaaagtccaactgcttcaggaggtgctgccacttcccctccaatacaggggaaattggctcttcccttctggaaggattttttcattgggggtggagggagacaatctggcagtaggctctagcaccctggcatgaaaacatgcccaggctgggcccaggccactccctggcagaggacttgaccacgctgcctcatgacatagcttacaggaaggaacaggccctccctcctcacatggctggttgattaggcaggctcctgcccagcctccatgcatgcatggagtgagcgctcacttggcttcaggcacggggatgcactgagcctttccaatggcctgccatggcaacagattgagcagcgctggaaagctgggatcaaagccaaagcaaggcagctcaactgagtttgaagcaggagaacagaaaacgtgggctaacttgtgagaggcacactgaacagccatgtgaagagacagatgcctgtggaagcatgcagatatatttaataagacacttgattaaaatctaataattaaaacagtcatgagaaagccactgagttatttatagatcacttgctcagataagaccaagaatcagaaagacaatgtaagctttagaggattataatgcaatcaccagcatctcagtaaatgatgggtgagggaagaatcggtaataccccctcatcaatttcacagtagaagcagatgtgtggcaggatgtactaggttaaaggtattctttctgtaagaacggaatgcatgcagcccagaggacaggggacatgaacaggaaacagagccatacctggtactgctcttagttatgggtcataaactgcatcagttagacacaggagaaagcagtgaacagttaatggaaggaactgttggccagtgttaactggtgacacagaaaggaaaggtctagccacctggaggggcagctacagcctagcccagacctgtaacttatcttctgagcagtgccatgcaatccaaaccttgcagccctaaagtatctatctgttcataggaaacaccagggtatggaagaaaggatatggaatttagaccctgagcctgaatcttagtctctgaccccactgacaggctccaaatggagacctgttctcatctcctgctagacagagcatgatgttgcaggagagaagactggctttggaggcagtagacctagattcaaacccaggctttattggccatataaccctcatctataaatggaggtaatgggagttaggaagattacatccatgtacacagagacttatcagacacttaataataacagcaatgaatatttaatgctaaggctataattaaacatatctaatccattttacagatgaggtcttaagaggttaaatgacttgcccaaagacacattcaagtccccacattctatgcagtgatttcatggttcagtatatctaagtcaagatcagcctctgttcctcctttgagaccatgaagtcacacgattaagtagggaaattagagagaggggatgtgtggagagacccagaaaggcagccactttagtggtgactggttcaaggtgcaccgtctcctgggacaccttcctaccatggtggcaattgtgagactgcgccaagagtatctaagcatcagaacagcaatcacatcacacgaatggtgaggtgtcagccaggcccagtctacattaagtgggcctgggagagaaatcactctctaccgatttttttgtttttttttttatgtttgtttggtttcttttttgagacagggtgtcactttgtcacctaggctggtaccatcttggctcactgcaacctcaacctcctgggttcaagcgatcctgctgccccagcatcaccccctctccaagtagctgggactacagaagtgcatcaccatgcccagctagctaacttgaatttttagtagagacagggtttcaccaggttgcccaggctggtcttctgagctcaagcaatccacctaccttggcctcccaaagtactgagattacaggtgtgagccaccatccctggcctctaccaatttaaatatggggaaacccactaaggatgctgatgacagacagtccggaaaatatccttagtcaagtgtgaactcagttcgctactgaaagagcatttaatagaaatgacatctcttctctgaaagctgtttaagcccagtaacaggatacatagtgaaaaaggaaaggaagatgcccagaccagatgggtgttttagttttttttttttttttttttttctgttttttctggtggcagggggtggcgttttaaacttgggggcttggaggggctgaggtcaaagggcagcgggtctttcactggctagaaagggaatagaaaggctgaaggaaaaccatatctggataaagtttaagttcactgagcatgacctaagactactgggagaaagttaatttccagcactcattttaccaaacctatgtaaccctgatcagggatccctgagttagctccagagctggaacagacagggcaaagggactgagcctccaaccctgagcagtggccaggcactcgacatgacaagctggaagagcctgaagaacgagctctcagaggagaaagaagggaaagagcctccacgactcctccagacgctcagtccagggccgccagggtcagccaccctccccgctgtctctatctgtggccctgccaccagtcactcaacccgactttttggtctagagtaagagcagcagctgtaccccaatggcacagcaaagcaaatccccctacaggcaccatgcaaggccagcacaggcagctcagtgaaggcaacagactccagtgcaggtccacaagggccccctgcgggagcgcctgtctgcaggatgcggggcagagggaactgaattggaagccaaaggaagagggcagctgggagcaggagcccctagcccttttcagaatagggcaaaggtactcagaacttctgactctgaggaagaggtacaagacctcctttcactgcagaagtatcccaggacttaagccatgggaagaattcacaaccttgaagtcagaagtgaaataaactgtgtggtgtccaatgaaggaggatgcctccagagcagaaggaaatggaggggtgggggtgtgggcaggaatgcagaacaggagaaaaaaaaaagccacctccacttccacccccaccctcttgctgctgtaacttggaggataatgaaaggctgtgcataagaggatggagaaacctaaaaagctctgcaccagagcttgcatccatcccaggcccagtccgaagccctgggggatggggcaggccccagaactcaccaggtgctgcatgcgcacagcctccagaggatagtcccctttggctgtttctccagacagcatgatgcagtcggctccatccaggactgcattggccacatcactgccttcagcccgagtggggcggggcttcttgatcatgctctccagcatctgggaggggacagagcattagtgagatgtagcttgagctgtcttcagagacaaatgacagcaagctgatcctctggatagtgagtaggtacacagagtatggctttgtgtaggtacatgggggaaggggattatctgtgtgttacgtgcgacaattccatgggaagagatcagacagcctccagagctttcccatacaaacatgcgagtgtgcacatgagaatgtggggaagggtgggcacatgcctgagtagcacagatgacaggcttcccagctcggttgcaccgtccaatcatcatcttctgagcaaggaagaccttctctgcaggaatctcaatgcctagatcaccacgagccaccatgatcccatcactggcctccaggatttcatcaaacctgatggacaaagttggggggagagaggttatatagaacagaggccacaagtatggcagtagacaagaagtttccctgggattccctaacttagatgtccttgtaccaggacagacatccatgatatcatcatgggtgcacacagatggcaaggcagtccagctaccttaggcccccagagtgggccaacaattctgcctgctgggcttcaacaccaatatggatgcttcattgacggaagaaaggggagagggcaaatccaaatgggctcattcccaaggtctcctctccaaatcccatgcatgttaggggtctctctagggcctccattttccaatcagcacttcaagacagggaacctgaggcctgatgactgcttccaccacaaagacccatggcctcatctagtcaaggacacttgaggactgccctttgaggtggcccactccaacctgctgaaggcaagagggaatgtggctttgcctggcctagggccaagttcagctagcctatggcttatcaggatggcaaaggggaggaccccaaattgcctggtacagaggatatctacacaaagctcagacagtaaggccactacagtgggtgcacagggttgctcccccaccctccccaaacacacttctaatccacaagagtgtgtctagcatcttagttgtgctgagttgtattcctagcaggatgccaaaaatggtggccatgcccactgggctctactttgtgagcattggggagggggtaagctaagttggggcaatctgaaactggagaagaaccacacatcttcctctgagagtggaatggaccataccagagttagcatgatcactgagccagctgcattctaagtgaagaccaggaggccataagctttaacatggacaccaggccctgaaattccacatggctccccaggaagggccaaaaagagccctttcttaagtgtctgctgtcatctttccccctggtccccccattccagcaaacactggtagtgtttctgatcaggaacagaacatcatggcccctggtcctgtgagcagtgaccctgttctctcaaatgttggtccccaggcccagggaacaatgtcaagctgccagcatctcaattacctgggaagcttttttttaaaaaaaacaaaaaaacaaaaacaaaaaaacataatgccttctactctcctaagatattctgattcagcaggtttggaactggcttgggagtctacattctgatgggctaggggctgggaatcagacattcacaggatggaccatgcccttcggagagctgcgctgggactggagcagggacaacggggacttgcctccgaaccccctcatgattctcgattttgctgataatcttgatgttctttcccttctctcccaggaccttcctaacttcatggacatcagatgccttgcggatgaatgacgcaaacaccatatcaacatcctgctcgaccccaaacttcagatcctggatgtccttctccgacacagcaggcaagtccacagcagccccaggaaggttcacacccttcttgctgcccaaggagccaccattttccacctccgtcaccaggaagtcggcacctgtatgaaaaagggtaagtaggggaggcagagcacgagggcacaggtcaacaggaagcaggcacctttcccgcaaggacagtgagctgggaagtggtgcattatgggtgctggagctgttttaccagagttgaaaacctactacactgtgtaatcctgggcaagccatttaacctctctgtacctcactttcctcacccataaataaggataattaagactgttctgactttgggaggccaaggcaggcagatcacctgaggtcaggagtttgagaccagcctggccaacatggcaaaacgccatctctactaaaaatacaaaaaaattagccgggtgtggtggcgggtgcctgtaatcccagctactcaggaggctgaggtaggagaatagctagaactctggaggcagaggttgcagtgagccaagatcatgccactgcactccagcctgggcaacagagcgagactctgtcttgaaaacaaaacaaaacacagcgaaacaaatatatatatatatatatatatatatatatatatatatatatatgtatatatatatatatatgtatgtatgttcctgtgttctccagaaccagaagaatgtaactatgctggattaaagcctatctttgaggataaatgagttataaaagggattcctgagaacacacagactcaatctcactgccaggcaaccaaccttcccatcttccttgtgtcaaggaagtttagagacaaaagactgttttagacaactggactccagctcccatacgtacctttctgcttcacctggagagaaataagcccatcatccacgtagatcttgctgcccacttccaccaccttgcagatgttcttgtagtccagccacaggatgttctcgtcacacttttccatgtaggcgttatccagcgtgattttgagagtggctcccttcttcagctccacctctgcagtgccgctctagggacaagagagtaagcaagagtccaaactggagacaccagtagcagcatcacctcagaaggaatggaaaagctctttcctcccgggaacaatgctcaagtcactgctaaaagtaatacagttttttgctcttattctctaactctgtatacttcacggaaataatccaagaaaagaatatgtttcagttatgctacttaatgatggggaaaaagatacaaagagatggttctccaagttagaaagcctaaagtttaggtttttagggtaaaaaaaaaaggttcctttgtggtaccatttcctagcaaagtagatcaaatcaacattgtttacagtgatgaataaatcctcatttgtagacctcaactcctctgcagtccttcatagtactgggaagaaacatggcaacccagcgctttggaggacatgtctctggggcatattgcctactgagccttcccctcgctctccgcagaatactcacgcccttgatgagcccagttcggatctcaggtcctttagtgtctagagccacagcaacgggccggtagaggatggggtcagaagcaaagctttccgtggctgtgcgcacattcttgatggtctccgcatggtactgggggaaaagaaggaagatgacaagcgtgctcccacactagaatccagctccaattcccctgcccaggagccaaagctgatcactcaggaaaggcccgtggatgtcttagagctctatctccatcctcagcacgatccatgcactgagaaatcctctacctgcttaatccaacctcctcagcctccacccacttctactacagcactaattcacccaaagggcaaatctttgaaatgtaggtggcaaatttcagaatattgccaccaaaacccattaaggtatgggtgcaaacatgtctcatcataaaagcagctgtgtccccagggctgttcttttttccctaagactcatcaaataccctcagcatataaagctcataaacagggcaaaaagcctaggacttgtgtttggataaggctggtctggcaatcaatgtcacattctgatatatgtggtaatgctgagagcttttcctctattgattccaactacaacgcaaacttgaagttattgacttaagctaacagtggcccaagctaaataactcattgctaaggtcacacagacctgattttctcaatcgctttgttttttttttttttgagacagagtcttgctctgtcgcccaggctggagtgcagtggcactatctaggctcactgcaagctccacctcccaggttcacgccattctcctgcctctcagcctcccgagtagctgggactgcaggcgcccaccaccacgcctggctaacttcttcgatttttagtagagacggggtttcaccatgttagccaggatggtctcgatctcctgatctcgtgatccgcccacctcggcctcccaaagtgctgggattacaggcgtgagccactgcgcccggcctcaatcactttctagattctgattggagggggaaaggtggtcatatgcctttctctaaatgaactgccctttattactccttgcttacaacaaatcctggcttcaatcttttttcttaagcctttcctcctttccatttaccattttgtttgtttaaaagagggactcaggctaagcacagtggctcatgcctataaaccaaacactttgggaggctaaggtgggaggacagtttgggccaggagtttgagatgagcctgggcaacatggcgaaacctcgtctctacaaaaaacacaaaaattaactgtgcatgatggtgcgtgcctggggtcccagctacttgtgaggctgaggtgggttatgtctaggaggtcaaggctacagtgagccatgatcacaccactgcactccggcctggataacaaagcaacaccctatctcaagaaaaaaaaaaaaaaaagacgcagagccaagatgtcaaaagagctctaagatagtgtcatcaataagacattagcggtaacaagggcacctaattcagcactttctgggccttgtcctttaaccaccactgtccaggaaagtggcacctgcaagtaagcctgcctgttattcacaggaggctggagggagctggagccagagcctagcctctaaagacagtgttgcctgaaacctgtgtctaaaaatcttcagcttcttattcaggcatacttcctaatgacagacccttggcttgtctgttttttatagggttccttataaattatgatattttcttgcttactggcttgtaatagaaatagaacaaaatagaatagaatagaggctgggcgcggtggctcacacctgtcatctaaacactttggaaggccaaggcgggtggatcatgagatcaagagattgacaacaaccaggccaacatggtgaaacctcgtctcaacttaaaatacaaaaattagctgggcgtggtggcgtgcacctgtagtcccagctattcaggaggctgaggcaagagaaccacttgaacctaggaggcagaagttgcagtgagccgagatcgtgccactgcactccagcctgggcgacagacagagtgagattccgtctctaaaagaaaaaaaaaaaaaagaatagtaatagttgttttcttttaaggggataggtggtgcctttccttcagagttgacgtgaggagtaaaagaatacatgaagtattaggacaaagtacatggtaattatctaataaatgttacctattatcatcttataatgataagactcaggtgtactgagttccactacagctgtggctttgttgggatgttatcacgtggataagagttccacacatcaatgctgtcctgcggaaggctctatatttagctatatttaggttgtttaaaagtcaaccttaactcaggccaggcgcagtggctcacgcctgtaatcccagcactttgggaggccgaggaggggggatcacaaggtcaggagatcgagaccatcctggctaacatggtgaaaccccgtctctactaaaagtacaaaaacaaaattagccgggcgtggtagcaggcgcctgtagtcccagctactcgggaggctgaggcaagagaatggtgtgaacccggaaggcagaggttgcagtgagccgagatcgtgccactgcattccagcctgggtgacagagcgagactccgtctcagaagaaaaaaaaaaaaatgtcaaccttaactctacttaatcccgatgtagaattttgttctcctagaataaaatctacttggtcatggatcaagacattcctttcaatcactactggatttggattattaaattttatttgttttctgcatctaagtgagactggtctagcacactaactgttagtacctgcctggttttggtactgtccttgtttgatctcagtatcagcgtatattggtttcaaagaacacagtgggaagatttctatatttctctaggctctggaacagtttaacaatgtaactgaactttgaaggggagacaattcagccactaaaatcatttggacttaagtgttctgaggtgaaccagatcttaatcactttttcaactttttggctggagtgcagtggcgcgatcttggctcactgtagcctccacctctcaggttcaagcgattctcctgcctcaggctcccgagtagctgggactgcaggcatgtgccaccatgcccagccaatttttgtatttttagtagagacagggtttcaccatgttggccaggctggtctcgaactcctgacctcaagtgatccctccgccttggcctcccaaagtgctgggattgcaggtgtgagccaccgcacgcccagcccactttttcaacttcttatggccactggtctattcatattttctatcttttggatatttatcttttctttgaaaatagccagagtcatctctctatataggaattaagttataagtctttcttgacttttaaaatctccaatgtgtaggaaatattctcttttctattcatactcttatttgcacatcctcgcattcttcacctggcttctcagaactttctattttactattttttccccacaaagaatcagctcttagcttaatctgtcaaatttattttcatttcattgagctataatcttacaaaattattttcttcaccctttttagggttttcctcccctagtgttctgagttaaatatttatttcatctaccttgagatctttgctttctaaagtaagcacacttcagttttcttgactttgttcttaatttccactaaaaaattttatcagagaatgtgtctgtataatttctactttatgaaacgtgggggtttttttggtggcctaatatatttttgtaaccatgagtgtttcatgcaaacatgcatttttggtcttggggatgtaaaaccatatattataaacataccaattattaggtatattattcaaatctatgtcatatatcataatctcttagagcatctctgggaggtgtactgagtcttccacttcagctgtggctttattgggatgttatgtggtaaagcatccatcaatgctgtcctgtggaaggctctacatttaggttgtttaaaagtcattatttctaggccaggtgtggtggctcacgcctgtaatcccagcaatttgggaggccaaggcggatggatcacttgaggtcaggaattcgagatcagcctggccaacaaggtgaaaccaagtctctactaaaatacaaaaattagtcgggtgtggtggcaggtgcctgtaatctcagatacttaggaggctgaggcagaagaatctcttgaacccaggaggcagaggttgcagtgagccaagatcgtgccactgcactccagcctggatgacagagcgagactccctctctaaataaataaataaataaataaataaatctggaaaacatggcatatggaaccacatgttcagcaagaatgcatcttgcccatgtgaactgccaaaagtgagggctgaagactagttgccaaagctgttaaaagagggctgggcgtggtggctcacgcctttaggaggccgaggcagtcggatcacctgaggtcacaagttcaagaccagcctggccaacatggcgaaaccccgtctctactaaaaatataaaaaaattagctgggcgtggtggcacaggtctgtaatcccagctactcaggaggctgaggtatgagaattgcttgaacctgggaggcagaggttgtggtgagcagagattgtgccagtgcactccagcctgggcaacagagcaagattctgtctcaaaaaaaaaaagctgttaaaagatcagatgcagacatttgatgtccctctgtcagagtgagagggaagacagtaatctcaacgttctgctcagaagagcatttaaaatagtcagaaactggaaaagtacgccccagcccctagtcaaaggtgcacatgaaacgatagccctgacgtatggtaaggctgaaactgtttacattacattatataaattagaataatttcagatcagtttccaagctgagcccacacacaacctcatcttggtctaaaacttcaaaatgaacacacaagagggacatctttaaaaaataaatagataaaaaataaaaaataaatcttaattataatctgggaataggagtgaaagtagagataatctccaaaagcctcttaaagtttaaaataccaaaatcggagccagctctcatccagcaggtgtggcaggtatcactcgcccttgccatgttagagctatgtggtgttattttactggatgaaggaaccataaagcctacttaaaggtcaacttcttaaaaatctatttctgctccttcccctgaatgcaggagcccatggcagactacagcagcagggatcaacagcgaacagacctccagcattgtcttcagctctctctaagctaagctaacacttaattctctaacaagtaattctcggtgactcctgctaaggaccccttgcttttggaaaactacagaattttccaaaaggtacagggacatgtcttaacctacatggtatgtctgctggacttggtcaggtccccatgacatttaagggccagccactagccaggccataggctgtttatgaacacaggttagggaatctatgatgaagagtcttgtgtttcccaaaaggaggaattcactcttggattgcatttcctgaggctttatttttagtccaaacttaataccaacttccaaatgccagagggcaacctctgtaaggcaattggccttacaggatagcattttctttactctcaacaggaaatacagaagccaagacaggtgcaaagtttgcctcttctgtaattcctcttatcaatgccattacgaaatcccatgatctatgggaaacctatggttaagtctgaaggttttaaaaaggcacaatcccaggctgagcatggtagctcattcctgtaatcccaacatttgagagaatcacttgagcccaggagtttgagaccagccaaggcaatatagtgagacctcatttcccccaaaaaaatttttaaattagccaggtgtggtggtgcatgcctgtattcccagctactcgggaggctgaggcaagaggatcacttgaacctgggaggtcaaggatccagttagccataatcataccactgcagtccagcctggatgacagagcaaaattttgttttataaaataaaaaaataaataagtcatggtacctcagggaaccccaagctcctcagaatgggttaattctaaatctggcaatggaggcaggaatggagccatcccaacagctgctacctggctcctgggcaaggcctctgtccataggtaaagccagctaataaagagcccagcacaaatacagtcctactaggctcctggggaagagtgctaactggtgttattttaatgtaccagaacccctgggaaggcacaggctgagaatacagtgctgaggaagtggggtattacaccccagatagtgcttatgcattaggctcagtccctcaaaacttagaatagtggaaaccgttctcatggacctgcccagttattttggttctaagctagaatcaatctgctagatggtttaccatggcaacacaaggtgaagcagaaaccctgggacaggagagtcaagcgctgtggccaggacacctaaggcttagagggttttccagtagaacctttccatatcttcctttgtaaaagctaagggtaggagaggtgtgtgggagaaccacagccagcaacaaagggggtcctttttgctaaaagagactcagccagttgctttgtcaggacaagagggaaggagagtagggatgggctagtaaagacaaacttcacactgactgtgaaactcagactcatccttgtctagtccactgtggctaaacgaacactgcaccccctccctgtttcctacaggccatcacaatggccatagggtccagccacagctcacctcatgagttccatgagagaagttcagacgagccacattcattccagacttaatcatctccttcaacgtctccactgatcgggaagctgggcctattaggaaaagttttaaagccacaagtattaattattcaaagaaggaaaaacatttaagtttgcttaagtttaaagaatttttttccctgaaaacttttcctctcccaaatagctcaaaagtctttaaaaagtgcatggaaggctactaccgtgccagcttactttcttgatctactgggacacttcgaccatttccttcaagttctgcaggctcccactgtatcagaaaagcctaggttaagacttggccagccttctccaccctcactgaaacccagccagatgtccaaccacagaatcttggtagcacagaacatgttagaaagatctttcctaggtctttaagttgctcctacaaagacctgctaaggaaaacatcttctaaattttgcctatagcataaaacctaaaccatatggattctttttgcaacaaattattttttattataaactggtaatttataatttgggttacaaagttatgtaatccaatacatacagtttggatacaatgtggaataattaaatcaggttagttaacatatccatgacttcaaatacttaacatttttgtggtgagaacatttgaaatttactcttagcgatgtttttttcttttttcttccttttttttttgaggcagagtttcgttcttgttgccaaggctggagtgcaatggtcagatctcagctcactgcaacctccgcctcccaggttcaagcaattctcctgcctcagcctcccaagtagctgggattataggtacccgccaccacccccggctaatttttttgtatttttagtagagatgggatttcaccatgttggccaggctggtctcgaactcctgacctcaggtgatccacctgcctcagcctcccgaagtgctggattacaggcatgtgccactgcgcccggacaatttttttttcttaagacaggatctcgctctgttgcctagactggagtgcagtggtgtgatcatggctcactgcaacttcaatctcctggactcaagtgatctttgtctcagcctcccatgtagccagaactacaggtgcatgccaccatgcccagctaattttttttttttttttttcactttttggagagacagggtctaagttgctcaggctggtctcaaatttcgaggctcaggcaatcctcccacgttggcctcccaaagtgctgggagccaccatacctcgccatcttagcaattttgaaatgtctaatactctcttattaactgtatttgccatcctatgcacatactaattctttactgcaacttcctatgacctgagtcctttcataagaatctgtgtagtatcccatgtagcacctaggtttgttaggacatttagttactcttttcaggagagaaaggtcactgcccatgaagcccttttttgggggaaggggcacacccactcaccaatggtacagatgatgccagtgttccgggctgtgatgggtggtgaatcaatgtccaggcggcacatgtgctccaggaatgtgtcagccatggctgcgtgcagctgctgggtctgaatgaaggcagtcccggcttcactatggggcttcgacatggctgctgaggtcctgggtcgagacaaattgaaagagagtggtaagactgagaagtggttaatataccatttagcacagaaggctgtctcctgcttacacattaactcaataagcacgctttgtacacaagccacagggaagccagacatgatctggttatgtgggtgctcctcatgttagaaaaagggttcaccagattgtgaacaatggaaaggaccttactgaacaagttaaaacctcccacccactccacatagtcccaagcacccacagtaagcaggtctctcttacactgggctgactgacatctacctagacagctttctcaccaccctatctataaataacatcatttaacatgcactgaaggagcttccaatgaaggaagttgtaaccaatcttccagtgatacaaacaactgactcctagcttagtgccttgataagcctagatctctgcatgtcaagctgtcacaaagctacaaatagctgctttgtcgtggggcacccatattgcctctttacaatcctcacccaaacccaaagtcattcccctgaatgcaaaagcttccatcccaggagtctaaacctaaaaccacatctactgttggccagaaggatgtcaggacacgcaaagcaatttgcaatttgcaaagcaaggataacataagggcactggtataattctgaaattatcacaactacattaacaggatagttgcaaacatagagaaattaaagttgctggtcaaatcttttccccaaatgatttttgatacacatcctgatttcttttctaagcctgacaagtataccaccactctgtaacacagaccatcagttccaggtaattaactagcccaggtcacaaccctgacaatggccccaacctttgctttcttcattaatgacttacaactaaactcactcagcctgttagttagctgattagagacaaaaactcaggagaagcttccaggcagtgtttgaataactatcaggtaaggatgtgaaccagaccaggcagtgtttgaagaactatcaggtaaggatgtgaaccagaagcttgctacacgtctcatcagaaagctgtttccttgagttctcagaccaagggctactctttctaaaacgcttgagcctaaatgcttcggccaagcaaggctcaggaacaagctcctctttagcccttccccacctcatcctaaatctcaaagttccaaatcaaggcatctcacacatatgacccttactcctttaccctgttccatctctgactttgtgggctctctgggtggctcgagtagagtatacatctaaatccatctctgccatctccaaagaaggcccgctgaggtccaaggagctctgaaggcagtagtgaacagtctgttggctatggaaaactgatggccacaagtcctcaaccacagattctaaaacttttaaaatggggaaataagataccggctaacggttcaacatggcaaatgcactcttcatttcgatgtgtatttcctaagcccctaatatctactacgtaccaaaatgaaaaaatcaatcctcccttccaggacctatatggttttgtatctcctagcacctagtatgtggaagcattccagtgtttgttaaatgacctttcagtctctctgaatgcctctttgtcagaatcaaagttatgcctctgctcccccttccctaaatctgaggaacttctgcattactgacaggaaagcctggggcccctggtccctttccctacactcatggttgagggagggctcgcataccttcagagctcccagctgggcttagggaagtctggctgttaagggaacattactgagagatggcacatcaggccaactggaacacaaaggctttgctgtggcctccaatgggcctacaatctagggactgtattgtgaacaaaataagatctgaataagtgggttggagtaactaattccactctttttaaaaaccatcagctggctcttcttagacctgagatatgagggtcttcctgtaaagacctggctggggccactgaatatcaggtcatacctttggttctctggggttgggcttccggtgacataatgctccccttttggctcagggtggctccttggcctcactagcaaagaccgctcagagctgaatacggtgtgccctggagagctgcacaaggattaaggaaaaagctgagtgtaactaaagctctttggggtaatggaaaaattaccttaataaccaggtatccaggtgacagctgctctagagattccactgttatgtctctttaaacctgtgatttactaacattccactattctatacaagaacctggtccctccccttttgggagcggggaagggacaccaaattaaacatacctaaaagacctgggaggatatatactgaaattttaataggacgtcattggggtggtaggattacagaaaaaaaaaaatcctctttattaacaaatttactgatataaatataaaaatacttttatagtaagaaattatgtgtacctcttttggaaatatttatatgcatcctataaaattgttgggaggaagtaaatgaaatgtgaagacaccaattccattaatcaattgctgctctatgcacttcaagaataatctgcttttaaaaggtggcagagaaaagacgcatgtctcaagttctgtacactgggttgtgattaaaaaaaaaaaacgatacaagtcttaggccctacatcacaaatgtactgcagaacagtttcaacggcttaagaaggtcaaccttaatacattcagaacctcaaagcaaaaaaaaaaaaaaaaaagtccacaggataatcccatgcctcaaacctgttagttacatgcccaaatccagcaaactagtttgttctcaagctttacagtaaaagcttttgacaatgttctggtacagaagggctgcctccaagtccacgagatgccattagcagataaaattatattggcctcaaacacaaaccctatttcaactatctcaaattaaatctgatgcctataagctctaattttttgccaataagtacaaaaatgacaaatgaaaatttctatagtggatttacgcattagcagtcaaaaaaagcttgcttgtcagcaagttcatccagactccagatctcatgtgtccttcatgctctctacccagccagagacctcatatctcatgcccaggtctttcctcaggctctgacctgaagcctcccttgcagggagggccagagctctcctgccttctccaaaatcctccacaagcctcttcccagcacaaactgcccatcccaccaaccacgtacctagagttgtatgtaaaacactcactggactcccctggctccaggagagcagcccagccttggtttctcagggcggacttctgggaaagactcctctccctcatgccagctgcctggacagtgcctgccaggacatgtggccccacccatgccagtctgactcactattgcatcctcctcctaggaaggcacagacatgcagagccaacctccagccagcagtggaagcctggcgtatccactgatagcagcacacaccatgcccaggtccaggagccttattcttgagcccgagcccctgcagtaagatcttcctcagagccatgtctcctctgtgagaaaggagacaccatctctaagaggccttagtctggagtgacaggttggaacaggcacaatcacagctcagctccaagtgccctattctccctttcctttctcatctcagacagctcctggctttttatattagtttcctttgtgtcagacacaattttttggccattcttcagaaaccaggagacaaaaatcataaaaaatacccaacactcctccctccaactttttttttttcttttttttttttttcagacagggtttcactctgtcacccaggctggagtgcagtggtgtgattatattatattatagctcactgcaccctcaaacgatcctccagcctcagcatcccaagtagctgggactacaggcacgaaccacacccaactcccatgctccacttcttagggccaggactgttgttgggttgtgctgggaaagattcacgcttcactccaccaattcttccacaaaggaccaaatcattctgccctaataaaatagcctggcccgtgagtctgcatctgcctaagtcatttttcctttgtaccaattatgctccgataccaacctcatcacatagatcaactataaaatgatggcacctgatgctcactttctccctccaacgttgccagtaggtacccaagattgtgttccttcctgtgacgtcagtttgctacctacacctccaagccatcatgaaggcgtttcgatccacaactcttccgaacacctgcatccgttagaaagtctgcatcatgatacgctggcattcaggtcagcctgctctctagttctcttcctcaacaatggaaatggagtttctaagatttgccctaatcaaactaggccagcaacatgatcaaaatgggtgacgggccagcagaacctagtaaggtctggaataggcactgttcatcttcatctatagttaagggtaatgacaataatgtatttgcatatgggtgcaggatacagaggataagatatcttctagctaagagacctgggtcttaagcccacactttaaccccaggaggccccacagcagaaagcagtatggtgttaccaggctacacagaacaaaatgagcccacttgtaggttctagtaaaattccctggctttaaaaaaaaaaaaaaaatcttggctcttttatttcttcggggctgaaagtaaatgacttgtcaacaggaacctaaggtcctatttccaactagagtgtggaatagggaagagcagctgatgctaaatgggcctacttccctcaaagaccactcaacttcaggtgaagaagccctaagtcagagacccctcaatgtcctcagatgccgaggatttcctggttccatcccagctgctcagtgcagagaactggtttcagcctgaaggaggtggtttgggggaagcattagttgtcctgggacatggtgcctccttactaggattaaaagtagggcggtgtttctgggtatgatatccacactctaaaatcagcaagggacctgggaccctgatttagggtcctcttaagtgcaactaaggtgggtgatggcctcagcaaagtgaggcactggctcaacatttactggaagggctgccctgcattctagtcggggggataaaggaggaaaggcagtgccaactctccaagagcactgaactagttactatgactggtcttcctacggcagcctttataggtttgcttctatgttacgaattaaagaaaaaaaagttttaacatctgcctctctaccacccagaactgaccattaacactgagccatggctggctgtgttggctcacgcctgtaatcccaacagtttgaaaggctgaggcgggcagatcacttgaggctaagagttcgagaccagcctggctaatatggtgaaacaccatcactactaaacatacaaaaattagccaggcgcgcacctgtaatcccagctacttgggtggctgagacacagaattgcttgaatccaggaagtggaggctgcagtgaacggagatcgcaccactgccctccagcccgggcaacagagtgaaaaactctgtctcagaaaaaaaggaaaaaaaaaaaaacacaaataaaggctgagctgtattttctttaatttcttttttctttttttttttttttttgagatggagtctcgctctgttgcccaggctggagtgcactggcgcgatctcagctcactgcaagctccacctcccaggttcaggccattctcctgcctcagcctcctgagtagctgggactacaggcgcccgccaccaggcccggctaatttttttttttttttttttttgtatttttagtacagacggggtttcaccgtgttagccaggatggtctcaatctcctgacctcgtgatccgcccacctcagcttcccaaagtgctgggattacaggcatgagccactgtgcccggccctctttactttctaaaaacaaaaacaagaattttaattttatacagttcattttttctccatccccaagctcctccaaccctttccacctccatcttaaacttttttttctattttatttatttaaatagagatgggaatcttgcgatgttgcccaggctggtctcgacctcctggcctcaagtgatcctcctgcatcagcctctcaaagtgctgggattacaggtgtgagccactgctcccagccacatcatgcattttgacacccaatcactgtcatgaactctatatccttccagttcactgaagtctatgtacagtgtatctatgtctatactgaaccctataatattgtggttttcttaatgccctaagtggtatactgtatatatcactgagtaacttgtttttcactcagcagcacatttaagatccatccagtgggtatatggatctagctaattcatttaagctgttacactagtccactgtacaacagaccattttatttatggactgtcttactggtggccactctccctccccgttaaactaagtttcttctattaatcaatactcttgtagtacatgtctccctgtactgtgtgagtttctatatatccagaaattgaagtcttaggtcatggagtatgtttatttctatttttactaaataaggctgaattgctctccaaagtggctatatcaatgaacgctgagttgctgccttccacacctttttccacacttggtactgccagactttttaaatgtttgcccatcggtgacatttgtttttctgctcatctaatgttaataaccaaagagggatacccagatagtttcaacgtttacaacatctctatttccctgcttaactcaatcaaatctcctctgaaatggcatggtggacacagtgtgtcttatgtgccctgactgactccactgatgggcagttctttttcgttcatggccaagggagatatcagttgtttaaaattgaagaaacatggccaggcgcggtggctgatgcctgtaatcccagcactttgggaggccaagacaggtggatcacgaggtcagcagactgagaccatcctggctaacacagtgaaaccccgtctctactaaaaaatacaaaaaaaatcagccaggcgtggttgcggttgcctgtagtcccagctactcaggaggctgaggcaggagaatggcatgaacccgggaggcggagcttgcagtgagctgagattgcaccactgcactccagcctgggtcatggtgcgagactccgtctcaaaaaaataaaataaaataaaataaaataaaaaatgaagaaacattatctgcaagtaaactgaagatgtttggaagggataggactcccttcagagaatcttgactgcagtattcagccagcagctgtgctggtccacagtgtgaaatgctaggactggcaacctcactgcccttgaataactggtcttggcatctctcccactgcagccccagcctgcttccaagactgcttgctggcatgaggaaagaggcttagggctccccaggagctttgtctatggacagaagtgggggaggtgagtctcagaggccaccgaaggtactgcagccggcttgttccctcctacgtgcagacaagcacaaaccactgcaggggcggggcttcaccgcactgcatggtaggggccctaaagcacccaactcctgagctgagcagtcataccaagaggcaggaaggcccagcagatgctgcacatcaccctccaccactcacccaggctcaccttcccccaacagcttctttaacaaagtcccaagtatttaaattactcaattatccagtctgccccttggtaaaaaaatgcaagctccccgcaagtatggtggtatcaaaaatggtcttcatatatctggttgtttagctctattcccatctgtatcagaactgatgcttaaagggacaacttaaaatccttaagacctcataccaaataaaccaatctcacgaagacccttgaagatgcaataaaactctgctcacagggtcaacgcattcttgtgttataccagctaattgagatttgactgtggacttttggagtgattcagaaagaagggtaatgtcaaatgagtcattttcctctactccggtctcagtcttagctcttggccaagataacacatcctgacttgccttcataaaagctgaagcaggccaggtgcagtggctcacgcccgtaatcccggcactttgggaggccgaggccggtggatcacctaagtcaggagttcaagaccagcctggccaacatggtgaaaccccatctctactaaaaatacaaaaatattagctgggcgtggtgcaagtgcctgtaattccagctacttcgggaggctgaggcaggagaattgcttgaacccaggaggtggaggttgcagtgagccgagatcacaccattgcactccagactgggcaacaagagcaaaactatctcaaaaaaaaaaaaaaaaaaaaaaaaaaaaaacaaaaaactgaagcaaaataaactaaaacccaagtaaagtgagtttgtaatgtaagtgctgcattttcttctaccttcctgcccacggccgtttcctcatttcttccattgcctcaatattaagaaataaacagctttaggaaataaaatggtttttcctgtgaccccacatcagtgtcacaacattcaaggcacagaagcaactcccataaagtgctagctgtttagagtcaccgccaccaaatttgctaagtcactgggggtacggttcttaaagagctaatgatgctctttgctaaaatatgaatacaacattatttctaatgcaatgcttaaaatgaaagcagttgtgctagacaggagaccaacatccatacattttggctcaagtcagtaactgagaaatgagttcaagaaccttctttaagtcatcattaatcaagtcccaggagaggcggctgtgcccgctacaaaagggccaggaatgaagctgcacagacggcattagctgggcaccgggctctgccagtctacacttaagctcttaaggcagtacagagaaccaggtgacccggaccaatcattttttaattagttgtggctttttttttttttttttttgagaaggagtctcgctctgtcgcccaggctggagtgcagtggcgcgatctcggctcactgcaagctccgtagttgaggcatttttaattaggggaaatgcatgcttcattatctgactcactgaaaggggagaagggactttttaagcctgcaagaaccacaatgtagtttccccactcacccagcgaagataattctctcaaaagcagaataattgaaaggttgagtcatcttccccacagagccccactcccccacagatttggtgatacgttacatttcccttccccacaagacagcccactcctgcccccacagcacctcaggccaccaaagggcaaattatttgctaacaacgctgcagcaggggagtcctgacctccatctcctctgtgacctagggagtggccacaccctcaagacggccaactgggggctactgaccctggctccaatcctaatctcaccagcaggcagagcaagtcaagggctggaatgttcctctggtaggtagtattctacttacagcggaacaccaaaggcttaactcagcccctccttgcctgcctttgtctacaggtcccaatctcagatgaccaaaaagcatctgctccaagcagagagttggaaagttacattatcagttactttgtcaatattaaaccagatcccttggggaactggtttccaggagacacgtggttattcagagagcctgattcctcacgattagctgtaggcgtttggggacagtaggaagacaatggatcaaggcccttatgctcaattgtggactaagtaattgtgctcaaaaataatatattcagtcacaggcttttcttctgggtatttcgccagagattagacacttactgagtgtgccacatccacgtaagcatgaatcctttcaaccatcatgaggaaaatgttactcccagttttcccaggggaaactgaggtgtagaggctgaactccttcagagtctcaggaaattaatgagtcaaacctgattctaaacgcctttttgacaacttcccaatgtctctctccacgtggaccttcactgtcggcctcactttaacccgtaccagcaaaggtccaagccctgggtctggagtacgtagattaagaagccaagggatgcccttacatgactgagtctttaaatgatcttcagactggaaggtgctttcctgcatcttctaatccagtgtgcttgccacctggtgagaccttacgaggcttcctgtccccctccctcccacagcaggaagctcgtaccccactcccagcattacaggagatacattttaagattgtgagctcggtgggctatgactcgtctagtcatcctggtctctaactctgacccccaaacagcccttgacccacaccgtttgcgttcagtgaacgcgacagatttcctgccccctccgtaaccagatccccaccccaccccgcggcctccgcgttccacaatcaggacgcatttgttaaaaaatgtgccggataattaaaaaaaaaaaaaagaaagaaaaaagaaaggaaaagaaagaaacgtgccggagaggcgcggaacgggcgagggccaggaggccccagcaaagcctgcagaggtttatcccgcccgttacgaggcccaaggccatcgcccggtgaagcggggtgggccctgggcgcggccgctacgtgcagcccggccgcggcgagatggagcgtggtccctggcggccacccggcaagggccggtcgagctctcgggccccgagccattcccaggccctcgcaggccgcccatctaatcccggccacaggggacggcaccgcgccgcaggggcaaccgccctgcctcccggcagcggggcaggccaacgttacgtaagtctccagctgcccccgggccgccgcatcccgcccgccgcgcggggcacccagcccagccctccgcccgcccgccccggacacggggcctcagcaccgcccgagcctgctgggagctgggaggcggtgatggaaaaggggggtgggaccgcgctcggagaccggagcaagtgggcgggcgcgaccagagcagagagggagggagggagcggacacgccaggcgaggaaggggatgcgggggagcggacgtgaccagcaagcagggggaggggcggcgagagggaactggggcgcgggaagggcggtcgcgcatgaatggagaatggacgcgggaggggaaccagaacgcagtttcaatgagttacacagaaagcattagaatcaggggacacgcacagcttgaagaggagggggtggaaggaccagacttaaggaggaagaggggaaaacgagcacggaacaggcggcgcggagaaaggggaagcaagggtggaatcaatcacgagggaccgagagaaggcaggcgaggatggaggcgcattgaggattggggcaggaggaagaggatgggaccagaatgagggggtagggctggggcgggaaaggagccggcggacccgcctgatctggaaggaacggcgctggggacttctgaagagcaggccccaggcgtgaggagccgttctcctctctctgagctccactgcatcccagacgccctggatcctgcgccgccctgcctgcgtgcccggggccggccggcgcgccgggattccgcactagccgggcgactggcccttggtggggactgatggcgtagcctcctgcaccgctcacctccggcgctgaccgactcgggctacgctgcaaagacgaagagatccggagccacggcgcgtgcagctgctgtgcaaggagccactgcctcagcctcaaggttatcccgctgcgggccgccgcaatccctccgccgccccgccctctgcccaatcccggctccgggcgacccgggccccgccccctgcgtccccgcgggcgcagtcaccttcaggaggaagcgcggcggcggcggcggaacgcgcgggcaggttgccctttcggtgggactaaattctgcggcggaaggacacagattcagagtcacattttaagaaacctgatgaccaatggggacgcggcggggcaacggggcccgcccccggagcgactttcctcccagacccccgggcgccgggccacctgttgccgccaagttgggctgccagatggggtgtcttttcttggctctcggcccaggccaccccagctgtcccggcctacctgggcagggcccagatttatgggttccggggcagcattctcccggccccgccctgccactccccactcctccgggtgtctgctctggcgcaccctcggagactgagctgaacggaaagttggggagagctgcagacttgtgcgtggttggaggtcctggccgccttcggaggggctctggcactggagcggcagtagggagaactagggactgcgaagtgggcctggagcgggagcgcgaggccgttttcctcttaggaccattcattgtgttaggaccgcggaacaaggaaggaccggttggggccatgtgaataatttagtagggtctggaatcctgcagagcgaatgcctcagagtagaaagtaaatagacggtgttgatattagcgcagagctgggcatctggaaatatcaagtcagaacattagggccgataacctatgcaggagtcagcatttctgttttcacctttgtcgtgtttaagtcagtattgttggaacttttcttacatttttctacaagacattttctgatttcccagttgttagccagcaactaatgatgcgagcagttatcaattaaacagctgttaactcttgccttcattcacagatacaatgttgcgcattcaaaatgtgaagaccgttctcttaggttctttttttattttcctggcaaaagagaccaaatgggtgtgacctgctcaggcatacccgctgcctgcagctgaatcacaggccttcattcgcttcctgttagctcagataagctgggaggagacagtgacagcctaaaagtaaatttctgtttgaagtgagataaaaatctttcactttcttctgtaagtctttcctggtccctttagttgttgttgggaaggaaatgcttgattattaaggtggtgaaagaacatgaagttgttgagaaggaaaaaagacatgcccccctagggagggttagattcctctctatcagagaaagagggatggcataaaagtccctccctggcccctgagctgaggacaaactaagaacagtggtggacaacactgggatggcaaggatctggccgatgctggactatattgtattttaaagttctaaattgtctgggtgcagtggctcacgcctgtaatcccaacactttgggaagccgaggccggcgaatcacatgaggccaggagttgagaccatcctggccaacgtggcgaaaccccgtctttactaaaaatacaaaaactagctgggcatggtggtgcacgtctgtaatcccagctactcgggaagctgaggcagaatcgcttgaatccgagaggtggaggttgtagtgagcagagatcactccactgcactccagcctccgtgacagagccagaccttgtctcaaaaacaaacaaacgaaaaagttctaaatctagatatgttcacaagactgaaatgtacatgtagagttgatggcaaactaactcctcagttgcagattttgatctgacagttctagaaatgctgtccacgagcctctggcagagacaaatccagcgaatcgttgctcacattaggtgcatagtaggccgggtgcggtggctcaggcctgtaatcccagcacttggaggcagaggcggtaggatcacgaggtcaggagatcgagagcatcctggccaacatggtgaaaccctgtctcaactaaaaatacaaaaattagccgggcatggtggcgggcgcctgtagtcccagctactcgggaggctgaggcaagagaatcgcttgaacccaggaggcagaggttgcagtgagccgagatcgcgccactgcactccagccttggcaacagagcgagactgcgtctcaaataaataaataaataaataaataaataaataaataaataaacaaacaagtgcatagtaaaaatttgtcacactgaaggtaattttctttttgccgataagtagcacagtatagaagatcaagcttggaggcctggtgccagccattggctcacgcctgtaatcccagcactttggttggccgaggcgggcagatcacgaggtcaggagatcgaggccatcctggctaacacagcgaaccccatctctactaaaaatacaaaaaattagccgggcgtggtggcatgcacctgtagtcccagctattcgggaggctgaggcaggagaatcgcttgaacccgagacgcggaggttgcagtgagccgagattgtgccactgcactccagcctggctaacagcgagactctgtctcaaacaaacaaacaaaaaaagatcaagcttgggttccatcataccttagttccagttccctatgaccaaatattgtaatttaatgtgtagaagtccagttcctcaaaagtaaattgaggacaatttacttttatggtggagtttgatgatgtatgtgaatgattccaacactgcccaataggcatcctctttctttgggaattgactagtcctggagggctgtccttgtgacacacacacacacacacacacacacacacagaagttttcatccaaagttccttgcttataactcccacagctcttgttagtcttttgtttataatgttgggggcactttaggctcagaagcaggcctcagagaacagaattctctctctctccctctctggccttcttctgccttcctttcacctgttccttttcccccaaggcagaaatcttcccccaactttgtgtcttggagctggctataaataagttatttgtcatatcttttctgattgtaggttgcaagacccccatttcagaaggggtcctgccctgtaccttggaggaagggatgctgcacagaggccaagacaaatctcgacagtccttgctgggttccctcactcagtctagagtatcactatgagatcataccttttggtccaagcatatttctacatggttatcaatcatgcctatccaaggaagttttcataaaaggcctacgaggacatgatttggagggctttcagataggaggttcctggaggatgccactcccagggagggcatggagcttccaggccccttcccccatacctggccctgtgcatctcttcatctttattcattataatatcctttgtaataaaccagtaaatgtgtttccctgagttctgtgagcctctgtagcaaattggttgaacccaaaaaggggatcatgggaatcccaaattgaagttggtcggacagaagttctggaggcccatactaactactgatgtccaaaccaggggcattcttggggactgggacctcaacctgtgggatctgatattatctccaggtacagtgccagaattgaattggaggacacccagatgatgcccgcagcagaactgattgcctgtttggtgtgagggcaaatcccccacatatttggtcacagaagtctgtgttgattgttgtagtggtggcatgagaacagaggaaaaatacagtctgagttggcttttccacaaacaccttctgaccagagccagaatgttttcctgaatttaagcttgcccttctctggaccatcactcctttgacccagtaacaggtcgggactacaggaaactggggttgctgaaggaggacacaggcttctccccctagagccagcccttccactgtgttcctggacttgaccaggatgggatgggaaactgctaggttcactggatttgggtgtgagtaaaagtggaaattggtatgttttctgtttggattcttgaccacagaatctgcagtttaatggtttaactctctaaaatcattgggagtccttggagaaggggtggtaagtgtgtcaacaaactgtaatgaacctaatcctggagcctaaagacaagctttggccctgatgaagagggtgagattacaggctttacatcaattatgtgacatcttagcctctatctgaaatggcagtgttctctcaggacaatacaatttccagggcagcctaccacgcccggcctctatgtgaaatttaaaaattagccagggccaggcttggtggcccacgcctgtaatcccagcactttgggaggctgaagagggcggatcaactgaggtcaggagttcgagaccagcctggacaacatggcgaaaccctgtctctactagaaatagaaaaaattagccaggcgtggtggcggctgcctgtaatcccagctactcaggaggctaaggcaggagaatcacttgaacccagaaagcggaggttgcagtgagctgagattgtaccattgcactccaggcagggcgacaagagggagactccatctctaaataaatagtatgtagagatggggtctcactgttgcccagactggtctcaaactcctaggctcaagtgatctgcttgcctcagcctcccaaagtgctgggattacaggtgtgggtcactgcaccgagcccaggtgaacttttttgtttttttgagacacagtcttgctctgtcgcccaggctggagtgcaatggcgtgatctcagctcactgcaacttccgcctcccgggttcaagcgattctcttgcctcagcctcctaagtagctgggattacatgcacccgccaccatgcccagctaatttttgtattgttggtacagacggggtttcgccatgttggtcagactggtcttgaactcctgtcctcaggtgatccacctgcctcggcctcccaaagtgctgggattacaagcatgagccactgcccccagcctgaactttttttctaggtcttccttcaaactcctacaatttcttcaggcctatgagggtggcatatcagtttccccagacaaatcctggaagataaagttagactttggagttagggataaagagaacaggctgtctgtgtggaaagggcatgcttcatggaggagacattcaagctaggcatggaaaattggttagaatagagataggtatggcaaggccatggtgtggggggtggccatggggagggacagttaaacaaatactgagtgttttctgaatgcaactgtgtatctaggtttccccaggctcctgcaacctcatcagtgcttagaatggaagggagaagcttaaggagtccttggtcactctgatggaagtatagtcttagccaaggtgaccctgtcaaccaatgtgacctccagcagtctttctccagcccagaaatgctgggctcactggacaaagccccgttagagtgatctaatcctatccaccaagcaactcccttcgaggccctgtgctctttttttccctgttaagtgtagccagagctcaggtccccaaagatgcaagtggcactataaacagaccctatccccccaaagtaatctgcctggatatactttggcactttccatcccaaggagaggcagagactggagcatcctgacacatggcatatggggatgagatggggcatcaatcaagatttggaagaacaagaaggcatcagtgaagccctgatcaagtgactccctcccaaggagccctctggcttcagttccaccagtctgctttttccctgacacacttccactctccacctgtgtctgcccttgctcattggctgccagctaatctgacccacttatcccaggaaggacagctaggactgaggagactttgggtcttctcctaagcaaaataatttttaacttaaagagtggcatctctggctcactgtgagaggaggagaggtctgatgcatttgtggcaagtcctgtgctccaaaggagccagtgaatcttcaaatgagctgcagcctaccttattcccacttctcctggggtaggagggctctacaaggaattacacgatccatagagcttcctctacaccactcctgaattagtcccagaagctgtggcatccctcagacctccatctcagaatccatcctgtgagaagctggtaagaaacccagtaatgactcagcaccagactcttctcccctctccccaccagccagaatgaaaggcagaatcgagcaggctcctccccaatggatggccacatcctcaccacaaactgagtcatggtcacaccctgcctgatggaaaattaccaggaggagggaaacggaaggttaaactccaggggtttgtaatttctcaacctaaaaatcagataaatgtttgaggtgatggataccccatttaccctgatgtgattattgttcattccatgcctgtatcaaaataactcaagtaacccataaatatatatacctactatgtacccacaaaaataaaaaataaaataaaaatagccatctactctgtacccagaactaatgaagaaaatagttcttttcctgaccctagtcctaaccaagcatgtctaggtctatgaagtgagactgcttgagcccaggactacatgaaaagtaggaggccgctgtcaacctgtatgtatggtatttgtaataggcttggccctgtggaggatgccttgttgctcacacctgggtttcacaggctccagcttccccacctccagaagaaccaggcctgggcagagaaaaggggcaactttacctcaattccccctccaggctgtgggaggattcctctccagaaactcagggtcccacccaagtttccctacaatgaaggcattcttgttgtttgtggggttttaattatatttgttttacctcatatatgttaagatattatcatttgtggcttctaaacttcttagatccaaaaagtcctattgcttttctgtggcactatgaaatgatgtatttaactttattacaattttattggcataaaaagattattatacagatgattttttttttaaagtgacacccataaggctagctcagctatttgagtttttctggtaatatacaccatttgttccttctcattccatcatttgctagtactgctatattggatgtcagtgatacagagaaactataagaaatgcttacgactgagaaaaatctattaacaatctttgaaattgaacagaaatgttgttataccatttgagtagccacacaccaaagttcagttgctggaacatcagtgagaacagttggagaccatctaggataacagagtggttaaaagaactcaggttctggagttggtcagatctagttagaaacagcactggctgcgcacagtagctcatgcctgtaatcctagcactttgagaggactgcttgaggctagcgattcaagaccagtctgggcaacatagcaagatcccatttctacaaaacaattttttttaattagccaggcatggtggcacatgcctgtagtaatagctacttgggaggctgaggcaagaggatcacttatactcaggagttgaaagttacatgagctatgatcacgccactgcactccagcctgggtgacaatgagaccaagtctcaaaaaaaaccaaaaagcaaaacttaacattgccaataaccagctgtgggaccttagatacattatttaagatctctgaagaaaacctatcttccagctttgttgtcaggattaaatgaaaaaatatttgtaaagtttgaacacttttcagcatagaaccagaacagcaatctggagtcaggctgcctgtcactagctgtggaatatgttacttatgctctgtgcctctgctttctcatctacaaaataggaataatcacgcctacttcataggcttgttctgagaattacgagtaaatatatgtagagaacttataatactggctgggcgcagtggctcacacctgtaatcccactactttgggaggccaaggtgggtggctcatctgaggtcaggagttcgagacctgcctgaccaacatggtgaaaccccatctctactaaaaatacaaaaaattagctggatgtagtggtgcatgcctataatccggctactcgggaggctgaggcaggagaatcacttgaactcaggaggcagaggttgtagtgagccgagatcacaccactgcactctagcctgggcaaaaagagtgaagctccatctcaaaaaaaaaaaaaaaaaaaagaaaagaaaaaagaaaatttttaataccaagcacacagtaagtaatccaaagtgttagcaaattattaaagtgcttagcataatgtcagcaccttcttagtaaaaactaaagaaaaggtcagctatctctaatactacagagatgggcacaaagtcctctcaggaggcaggtatttcagtcagagtgggctcagtgatgaggtcatttacttggtgaagaggttatttcctagacctgaaaccagaatgggagaagagggcttaggagacttgtaaattagaatgtgttagtgttgatcaagaatgagcaaagtttaagaaacagcttctagagggatggaccttaagaatggtacttgcatgttaaagcaggtcaggaactgaaaaccagggtaagatacccaggcaagaaggtacctctaaagtacggtgaaggtgatgaaagacaacaggtagcctagagtgtgctttgtaaatcaagctataacagattaaaaaaccctatccttgaaatgccaggcttatttaatgctttttgtattctctgtgcttatattcctgtttttcttcattaatatttcataaagtatataatcccagcactttgagaggctgacacaggcagatggcttgggcccaggagttggagaccagcctgggcaacatggtaaaacgccatctctccaaaaagtatggaaattatccatgtgtggtggcacctgcctgtggtcccagctacttgggaggctgaggtgggaggatcacctgagcttgggaggtcaaggcaacagagtaagaccctgtctcaaaaaaaaatttttttttcacaaaatatttggaaatgtccaactgacacagctatgcttataactaaggatctggggcacatgaagcacagcctgaaaggccagcaaaaggctgaaatgggaatttcaacagggagaagaaaaaattcactacaacaattaggcttcctagaaagagctgccttcctttaccaccttactaaacttggtgaaattgggttgtttcattaagtgaagctgcattcccttaggatgtctttatagatttcgacttagagacaaaccccacttcctgctcccaccagttctcccctaacctcacttaccctgaagaaacaggttggaggagaaagagagtaggggtccagttcctgagatatagagcaagggagactgggcaggtttgtgcagaaagcaataggccctaaaggcagtaaatcttagctgctctggcctcaatggcccttttaaattttgactaatagtcattagtggtattctatattctcggtttgtttcatctgcataactgataagtttccctttaatccactgattaaaaagctgacacatctgtagtatactacaataaatggacacaactttgataccatgcaacataaacagtcccaatccgcaggatattccagtctccccaccccctgccccttgtgagggcttggggcaggtgctgctccaaggctagtcaaaccacagtgatcatatccagtccacagcaccttccattttattgttttatttacaaacagggtgaagtcaaagggaaagtcaggggatggagtcagtctgggccatccgaatgtggagtagttcttgggtcaagctctaccatgaaggccacctcttacatatccttttcctgccccttggtaatggccccttgattcctcagggcagcctcagctgctgtacctgaacacttttatgagggcagatggatcctggggtaacaggggtggtacgagggctggggccccctcagtttgtgtaaacctgagttccgatcacacgcatgatttccttctgtatcttggggtcctgagtattaatgttggcatcgcccacctgaccatcctcatatctgccaaagatagggcaagtgtgagcataagagggagaacaataccagaataacatcaatcagtggaactgtatttcaaggtatggccatcccatcccagaagtcaaagccctttctcactgcttcatagtggaagatattcagcttatctggtttcctctagatagatcccaaccatctatacccattcccatcctccaatggtaaagtcccagtgacagctccactcaggtagccaaggacatgtctcagataacagaaatagacttttcccagtagccacacaccatcacacccccaacctcactcctcgagtaatccccagagtccctccgacacttacacaaagaagaatcttgtgcagacatggtcggacacagggcacacccagatgttcccatgcttctggaggtccttagatgtaatcactgggagaaagagggccagaaatcatagatacaatgcttaaggcacagagtccaggcaggagaaggaagccatgccacttcaacatcactcttggccagatcatgtgccaaaattacatcagaaacaaaggttagagacccagaaaaacaggacatgggcaagctacctaccttcacaaagtgctatacagtttagattccgactctgcaggaaccgtgactgaatggatcgggtctggaagagaaggaggcaaaggagaccagagccaggtagatgggtacagctttccctagagaggctggttagctgatgattgggagtggggatcagagatatcctgggctcccagcaacacccctcgccgcccagaaaattcttctttcccataatcagtctggatagggtcacagcttccatctttacattttcatctaaactcagcctctgcttttatactcatgacttcagctacatatgactccagacgtgtgttcactttagaacatacctgactcctttaaatgatctcaaatcactccccaacccattctcaccccactgtttccctgtccagctctggagcctaaattagccccagggaaaggtcctgcctcattagaatagttccaatacctgggggatggtattcatcctgttgtatctctggaccagctcatccttggagggcatcctgtgctgtccttttcccattcctgtcacagaacaatacacccacttcatttatcaaaaatttacgaaagtgcctactatgtcccagcactgagctagatgctcatcaaaacagcagagaataaaacaaagaagattattttcccccacagaatttagtctgctggaaattacaagcaagaacaagtaattaacaacacagcatggtaaggggttgtgatgcagattatagagcatggtgtgagcctagaggagggcaactagcctagcctaagagtttaaagaagtcatgtggtgacagctagactgagaactgcaggattaggaagagttaattaaataaacagcggggaagtgtctgggaagaagtaataggatacagaaggcctgaaggaaagataaggtagtgtgtgttagttgcatagagaatagtgaattgcagaggagtggtgagaaatgatgtagaagaggcaagctaggatcagatcaagccggctttgcaggccatgttaaggcaactaaagtctatcctcagaacattagggaaccactgcagggttctaagataggggagcagcacatgaaatcagccaggaatgaggggcccaggagagtgggacatcaataccttggtgtcaagtgcctggatgagtaaaatgaatggaaaggaagcaagcagaacaagtcagatttgctctagtctcaaagttacattaaaaacctgaccagtcattcaagagaaaagcatcagcagttaagtgatgaataattttgtacaggaaatcacaatggcaactaacttgaagaatcctacttcaaacagtcttcccaggcttgagaaagaagtgcccattccttctagtttccacattatctaaatccataaactctctaccttccttacccgtttataacatttatagactcaacttggacttttcttatttagatatgaaaatgtgcttgtgtgctcccactcctcactctttttggtttgaggataggacgttaagtctctgtactcagctttatcataggcccaatcttaccacagttagggataaaaatgtctacccatgtgtggacacacgtgcctgtgtgtgtccaccagggagagagatgaagatggagatgatgctatcattataggtcataagcactctcaccactctaccctggaactttctattactattaactccactctgatcagttcttggttttctcatagccatggtgtagaaatagactgatagctgttgaactgacattcttcactgctcaggctgtcaattcatcatgcatttacactcaagtctcgtgacagatttaggtagggcctgaacaaaactcaggacaccaagagcctcaaggcttgaattgcccatttcttccttttacaggacaggtactcataacccctgttttcaccttccccattagccttaactaggttcagctctccacccaaacatcatgaccttctctcaaactgggtatgtcagtgacaaaaagtaaaattcccattcaggttatactccagaggaggcacataaaagataataaagaacaatctgatttctctggcaggtcttagagatggcccttatgatataacccaaatcttgtcccaactcaatcctgttgtacactatcctttccacactgatccaatgattgtccatttcctgagcccagaacctgagatcatggtggctagaataatccctagatgttctgtgtccagagtatgcacttatcagaagtccctaaacaagactaaacaaacagatggagtatatcacctcctttttcactgtcccctatttcaacctgaactttatagccaagtcactggaactagatatatgaacgctatttacaccaaccctcacttccagagggcactcaatgccattaggctaaagatagtgtgagaaagaaaaaacagaaaaccagagcagaatagcgtagaagaaaacatacaagacagttggtcaaatgctggagtaactacagtaagtggaacatttgcacacatttcccccaacatcccattatacatactcacatatctatagggccctcagagacccgtcattcaagcaaggcctactctgtcagtctaatatagtgtattagtccattttcacactactgataaagacatacccaagacttggtaatttatacaggaaaaagggtttaatggacttacagttccacatggctggggaggcctcacaatcatggtggaaggcaaggaggagcaagtcacatcttaaatggatggtggcagccaaagagagagcttgtgcagcaaaactcccccttatagaactatcagatctcatgagacttattcactatgacaagaacagcactggaaaaacctgcccccatgggccaggcacagtggctcacacctataatcccagcactttgggaggccaaggcaggcggatcacgaggtcaggagatcgagaccatcctggctaacatggtgaaaccccacttctactaaaaatacaaaaaaatcagctgggcgtggtggtgggcgcctgtagtcccagctactcgggaggctgaggcaggagaatggcgtgaacccgggaggtagagcttgcagtgagctgagaccgcgccactgcactccagcctgggcgatagagtgagactctgtctcaaaaaacaaaacaaaacaaaacaaaaacaaataaaaacctgcccccatgattcagttacctcccgctgggtcccttccacaacacatgggaattcaagatgagatctgggtggagacacagccaaaccgtatcatatagtgataacaacaatggcctagaaattaggagacctggattgcagccctatctctgctactcatagctgtgtgaccataagaaaatcatttaacttttctgtatatcagctttcttatctgtaaagtaataagggattaaattagatgatctctaactccaatagtaaaattcaactgcattttgtatctataatcaattaccctttgagagagggagatgaaaggtgtctatgatatctttatgtaatcggttaagtgatgaagaaagacgagaggtcaacagagatttctggcttcatctggtaactaaaggtatttaggcacttggtagtaaacaaaggccagggggagaaaagagaaagaaagggagggcatagggagaaaacagaaaagaagaatctcagtgggcaccaagaaccatgagaatctcactactcggaaagacaaaagaacttaatcagagggatgcttaggctgagacaaagataaaaagtgaagaatccagacaaatcaaaaagactattccaaccctaaccccactttggatgccaggcacacagagtaagattcactcatatattcaataaatatgtgttggtcacttgccctgtgtggattaatcataatctttgtttcataacacattattgttttgttttgtttttttgagacggagtctcactctgttgcccaggctagagtgcagtggcacgatctcagctcactgcaacctccgcctcccaggttcaagtgattcttctgcctcagcctcccgagtagctgggactacagatgtttgccaccatgtccagctaatttttctatttttagtagagacagggtttcaccatgttggtcaggctggtctcgaactcccaacctcgtgatccacctgctttggcctcccaaagtgctgggattacaggtgtgagccaccatgcccagcctcattattattttttaataagacaatgaatacccagagacccaatcaaagaactaaattctaaacctaaaacattaccagtgacttacatctaactatatgcctccctttggaggtaatcactatcctgcaatttgagttattattcttttgttttttctttttcctttagttttcacacacacacacataatacacatatatatgcctaaacaatgtttaattttgtttgcttttgaacaatataaaaaaggcatcacagtctcactctgtcttctgggacttccctcttcttattgaacatatttattattatttttttttttgagatggagtcttgctctgttacccaggctggagtgcaatggcgcagtctcacctcactgcaacctccgcctcccagattcaaacgattctcctgcctcagcctcctgagtatctaggattacaggcatgtgccaccacgcctggctaattttctttgtatttttagtagagatggggcttctccctgttggtcaggctggtctcaaactcccaacctcaggtgatctccctgccttggcctcccaaagtgctgggattacaggcgtgagccactgcgcccagccaaaaagtacacttttattactaatcttttgtggttatatgtgctgcaaatgtcttctgtcggtttgtagcctgtctcttcactttctttagggtgtcttctgaagaatataagttttaaattttttttcttttttgagacagggtctcgctctactgcccaagctggagtgcagtgacatgatcatggctcactgcagcttcaacctcctgggctcagtgatcttcctgcctcagcctcctgaccagctaggacttacaggcacgcactgccagacctggttatttttatttttttgcagagatggggtattgccatgttgcccaggctggtcttgaactcctgagctcaagcaatcatcccacgtcagcctcccagtgttgggattacaggtgtgagccactgtgcccagccagaagtttttaattttaatatagtcaaatttatcaatcttttatgatttgtaattccattttttctattctctggaagactttagataaaactaaaataatttgttccttgaaagtttaagattaatttgtaaaaccatctgggcttggtgaggtttattttgtgtgtggaaatttttacacaatttctatttcttttatagtattatgattatacaggctatttcttgtcagatttgttatctttttctagaaatttatccattttatcaaagtttttaaattattagcatagtgtaggtaactctcttattactttttattttttttttaggcagagtcttgctttgttgtctaggctggagtgcactggtttgatcttggctgactgcagcctctgcctcctgggttcaagcgattctcctgcctcagcctctcgagtaggtgcatgccaccatgcctggctaatttttctatttttagtagagacaggatttcaccatgttggccaggctggtcttgaactcctgacctcaagtgatctgcccacatcagcctcccaaagtactgggattacacgtgtgagccaccgtgccccgccttattacctttttaaattctgcttatctatagttgtactgctttttttggtcattatattatttaattgtgtcctttttctcttaatctaaccagggtttatctgttctgttagttctttgaaatcatctttggacttttttggtactatctattgtacctatttttatttcacaggtgttagttcttacctgtattatctccttttttctattttgtttggtttattctgttgttagagatgtttttaggcctctgattctggcactttcttttttctttttttttttgagacggggtctccctctgtcaaccaggctggtgtgcagtggtgcaatctcagctcactgcaacctccgcctcccgggttcaagcgattctcctgcctcagcctcctgatggcactacattttctgatctttgtaacagttacaaattactacaggatatcaagtaataatctattaagaatctagcacaatccccttcatgtagtgaacatgcaactacatggtgactataccttgtacagagactacatcaaacaagcacaaaagcagactgaaaatgaactaagacataagccaggaagactgagagaactctaaatcagatttccttttctgagcttgactcatctcctgattagaatctggacctcatctttagaataaaatgctttatcttgcattcaatgtgactaacataatagtgtaagattatagacagtttaaattttaaaagatggttgagagagagaacagtgtctctagaaatataagccaatggaaaggacgcaagccttcaggccttcagatgttttcacatgtaaacttacatgtacaagtatacacaaacacaatctataattgccaacaccaaacgtgttctacaaaaagccttgttatgtccctgttattcctccacccattcccagggccaagcccctgctatgaataaaaccatcatttttaacaataactggcctcaccttgtaaagaatctaaatttctaataagaaaatgtagagagagagagaatatgtatccatgatcggggagagagctgacacagaccaagtatccataatgagggaggaacagacagcacaaatcatgtattcacaaatggaggcaatgtaaatagagtcaaggtggccacagaatatttcttacctgagtatccaaaggaaatactggagatggggctcaggtagatgcctttgccataggctgctccatgcagcttgcagggaaacaccaggatgagtaatatgagcctgggccctcccatggctatttattaggcagcagcaaggcttatccagccctctgtccctccttctaccttctcattcaagtaaccctaagcacctattctcggaaagccaactggctgaaaagtggatgcaggttaacctgcttgcctatgaagtgctacatactgacacattcgagagtgggaaatggtagaaccactgagtcagtccctcagcattcattttcctgtctccaggccttggtacatatgcagattccaaaaaagaggaactacagaacgggtagccagaaggagggccaatacacactccctggagtctctcagggcatagaaaaagtctcccatatctactccttgaatgaatagccacataaattgaaaagctctaatagattaattcatcacagtggctacaatcagcaattccatattcctgcttacaggtacattcccattccccaaaccaccaaaaaaacgcagactgagatcaaatacacaacagccacgttctctattcatacagttctaacttcctctctagggaactccacaagacaggttaggcttgaggacactgaggcaaaaacagcttactctagagcagccttccacaaaactgagtagggaagggagcggttagaaataaaggagaaaggggcacagcctcacctgcagtttggtgtaggatgcattgaccagcccattgcgcaggatcgaatgccagttctcaatgtgggacccactgtaaggcagggtagaatacatgtctccttatgatatgaggttcccaggaacactcccaagactgccattcccacccattctcacccacacaggacatgaagatggacaggtacacctagtgatggacatgcacatggatacagtcacaggcatgcaagatgtgtgtgtgtggttaaactctacgtctctatttccagtcccatcctctcttcggtgcttcagctactcccatcctaaatcctcaactgctggttcagtatttttatttgcccattatcctgacatttcaaattcaataaattcatctgaaaatcaacaaatttatcactgaccccaaatatggcttccagttctgacttcatgttctattttaagaaaagggtactaccactccctataagttctctttaatacctctctttctctttccctcctctcaaaattaggcataaattgtggatttttccatcaaagtagctttcagatctgttctctccaatctatttcttcagccacatcttttcacatgtaaatgtcatttttcctcaactacatcataaatagtttgagaataaagaccacattatatgtacctttttgtcctctatagcacctaccacaatagcatttagtaagtatctgctgactggttgatggacacatgtaacacaaactcatatctcaagggcatccttcttgctcatccccgccccctcaccacccccactgcccagcccccagcctcctcactggaaggcaaaggtgctgccatagagcttcttggcggtccggaaccgagcctccttggcaggagggctgctcagcaggaggaactggtgtgaggtgtgcatgaacttcagctgctgcccagggtgggggtggaatcaggaaaacagagcagaaatcgagatcagggagggaagggttggggataggggaaaaaatcaggcttgcattaaccccacacaagggaaatatgctaaggcccaaagactaagttgatggacagagcaatgtaggcagatctaggaccaatatggttagctggcttccagcccctccctgcccctcaccagaaatttaaagcatttagagggagaatggtcacttaccctgctgagaggtagtttgacaatgtgtgacctgttgctagagatgatcctgggaagaaacagaaaaaaataaaaaggatagaataattatgtatttaagctatcctttctgaacaagccagtcttcctctgcctttgggagaataaacaaggattcctgggctgtccaaattgtgtgaaatgtcaaggtcactatctggatattcctgtgggtgatagtgcttatgaataaaaaggtaaaaaggaaggtagtgaccagacacaagctaattattggggagttaaacaatggatgaaaaaaaaaaaggggtgggaggagtgctgctacaagtagggagtaaaaagggtagaacaaaaggaagagcacagaggtcacctacaaaaaaagaaaagaaaaaacagcaagaggtctgaattagaatggtgacaacttatacctgggatttagactcagattcagacctgggctcagaagccatccttccttagcttaagagaaaacatgaaagctctcaggaatggggagaaacggagagaaagttactgtctaggctggaaaaagaaacagaagaaactagaatgaacttccttaggagtcaaggacagactaagctctatacaggctgaacacagaagatagaagagaacagacataaaacactgagggctcagcaagagagcactatctcccatgtggatacagtttgctgttgtctttgttttttgtgcctcatctatgtacctgtgatgccacctcagatggtctatgcctggttattcctcaggctaagagggagaaagctgttgcactgaggaagtactgaaggctgactaggaagagggaggcaaactaaaaagggaaagctatgtcaggaaaacaatagaaattgagatcaggaatggatggcagcagggacagtcaaaatcttggctaggagaagagcacagcaatagtgcctcaaggctctggacattctatatcatcaaggaggcccagagacagggcaaggggatagcaggaggagacagacgtctctggatgcaaagaaaacttagttgaaattaacagtgttaatttctacatgcaaaggacacaaaaacctattggtggtgactatagttagtaacaatgtgtaatattcttcaaaatcactgtggtagattttaagtgttctcgccacaaaaaatacatacgcgagataatgcatatgcttattagctctactgaaccattctgcaatgtacacatatttcaaaacatcatgttgtacacaatacatgtaattttttttttttgagacggagtttcgctcttgttgcccaggctggagtgtaatggagcaatctcagctcacggcaacctccgcctcccgggttcaagcgattctcctgcctcagcctcccgagtagctgggactacaggcatgggccaccatgcccagctgattttgtatttttagtagaaatggggtttctccatgttggtcaggctggtctcgaactcccaacctcaggtgatccgcccgcctcggcctcccaaagtattgggatcacaggtgtgagccactgcacccggccctgtaatttctatctgtcaatttaaaaaataaattaacaaaccaaaaaagaaaacaaacaacaaaacctattgcgaaacatggaacacctaaagagaacttgaaaaatcatgtcagctgcacatcgtggctcacagctgtaatcccagcactttgggaagccaatcaggaggatcacttgagcccaagagttcaagactggcttgggcaacatagggagactccatctctattaaaaaaaaaaaattagctgggtgtggtggcacatgcctgtggtcccagctactggggaggctgaggtggatcacttgagcactgaagggcaaggctacagtgaaccatgatcgcaccactgcactctagccggggcaacagagtgagaccctatctcaaaaaaaaaaaaaaagaaacaattaaaataagattaaaaataatttttttgaaagaaaaatcatgtcagaatttgtgggcgttttgtaggatgtgttattttcaaggcaaggtatgccaacaaactccaagaaaaagcacccattactgcctataaccttgggaaggatgttgaaaccaccactaaaagaaggtacaggttccatgtccaataactccctccctccccataacccaagaaggatgagccattctatccataccactgcaggagaggatgggccaggggatccaacttgtccatctgtttcttgatttccaaatatgagccctgtaagacaatggccataacgttatctccttggagaggtgggagcctacctgctttctgcttttcacagagtgactattagggtccagggcaaggtaggcaccaaaggccacacagaggaaaaaggagatagggttcccaccctcaaggagccctagtcaggctgggaagactcataaataaatatgaaaatgactgaagatgcttacaaaacaacatgcaggtgggtctccctcattttatgcaattcctacagccctaaaaagttgattataaatcaaaaaataaataaaatcaatgtcccaagaagattaggctaaggaatcctgtggtaaatctttaaataatgcaaagcgtcctcctgacaagtaaatcattcctcctaggtgtatcttatgtgtaaatctcaactgtgatatacaggatttgctgagaagaggcccacctgtaaatgagtacaaatgaatgtctattcatgcagagattgcagacgaggggtggggaagtctggtgagggacagccttgagtcaaaggatggtcaccgctccatgtggctgccccacccctagaaggatagaagatgtaggcccctgtgtctagttccttaccttcaagcccccctcctcctcaccctcccaaccctgggcagaggtctttccttcacttcttaactccctaagaattatggcaaaacattaaatatgaacaacttgtaaaggaattaacagcaaaggtaaagattgagacacaaagactaaagagaataaagaggagtaacagagctaacaaaacagagaacaggaattgggaaggttaaagaggaaagactaaaaaaaaaatacagtgcgtagcatctctaaatcttcatcccactcccacaaattaccaacagaataggacacttgaactgggcaggcaaaggagaggggacagagagaaggcagaatacctgggtcatctcccgaatagacatcacactatccagagctttctgaagccgctcataattcttcttctgtggagaatcaatgggaagagaagaaccaaataaagaaaagtagaggaaagtaagatgtgatgaaaaggggctagatgtaccaaaaaagtctaggccctaggaaacaatagtatgtcatggaaagagcattaatgtcagacagttctaggggcacatgctagttctcttttaccagctgggagtaacagggtaagttatttggcctcttagaacctttagcatccctttatgcaagtgaagataactcctatcacccccatagagatgttctgaggattaaatatcatatataaagaactctgtatagtaatgacagtaatagtgaggtactatgctgggtacttgtgatggttaattttgtgtgtcaacttgactgggccatgaggtacccactcatctggtcaaccattatttctgggtgtgtttgtgagggtgtttctggttgagattaacatttgaatcagcagactgagtaaagcaaattgtcctccctaatgtggaagggccttatccaatcaatcgatgacctaaatagaacaaaaaggctgactcctctgccccaccccgccatgagtttgtagagtttgtaggtattcctcctgcctgattgcttgaattggattatcagtcttttccagtctttggatttgaactaaaaaaaaaattggctcttcttggatgttaagccttcaggctttcagactagaacttacaccattggctctgattttttggttttgtttttttgaggcagagtctcgctctgtcacccagcctggagtgcagtggtgcgatcctggctcactgcaacctctgcctcctgggttcaagcgattctcatgcctcagcctcccaagtagctgagattacaggtgcccaccaacatgcctggctaattttttgtattttcagtagagacagggtttcaccatgttggccaggctggtctttaactcctcactccagtcaagtgatccacccgccttggcctcccgaagtgctaggattacaggcagaagccactgcgcccagcccactctctgatttttcaagccttgggactgggactaccactgtaccactggctctcctgggtctgcagcctgctaactgtagatattgggacttctcagcctccataatcatgtgaggcaattccttataataaacctctttctccttctctctccatatatatctcctattggctctgtttctctggaaaaccctaaaacagtactttacatatattacttctctcttttttttttttttttttttttttttttttgagacagagtctcgctctgtcaagcaggctggagtgcagtagtacaatctcggctcactgcaagctctgcctcccaagttcatgccattctcctgcctcagcctcccgagtagctgggactacaggcgcccaccaccacacctggctaattttttgtattttttagtagagacagggtttcaccatgttagccaggatggtctcgatctcctgaccttgtgatccacctgcctcagcctcccaaagtgctgggattacaggcgtgagccaccgcgcccagcctacttctcatttgtataatgatctgcaaaataaatattatccctttttacaagataaggagattgaagtttagaaacgttaagtgacttgcctaatacccttcaaatggggagtagcagaatctcaaatggaatccaggtctgtctggctccaaaagccctttttccctatcataatgtaactaatattaattcttctcccctttctgtgtcaaacttggctatttatttactgaaacagctaaatcacagagtttaagaattctgtcccttattccaagccctgtatataccagaatgtcagcccatagtctgccactatcttttatcatttctgttccttagccctgactttctcaagtaacataccttagggttaaaggccagagtcttgggatcagtggggtccaccacagagggataaggctcaaagatgatgctctttctaggggactctaaagctgccctacacatggccaccagcagatccaccaccttaggggaaaggaaaaaaaacagggcagaagctaaatgatttcccagtactgggagtcagagtacccagtatttctctctgatgttcttttaaaaagcaaatatgtttaaggctttcaaaatagaaaatacaagctcataaaaattcaagtaataccaaagtaattaaagataaaaaaccatcttcctgcccttaaactaatctcaattctcacagctaagtactagtgagtttgatgtatatccttccagataattttcctacggaaatattttcttttctttctctctcattcttttttaaagagacaggggctcactctgttacccaggctggagtgcagtggtgtgatcatggcccactgcagcctcgacctcctgagctcaagccatcctcccatctcagcctcccaaagtactgggattacaggtgtgagccactgtgctcggccctttattttcttacatggacaattttactacatatgctgttgtatttgcttttttatatgactatgttaaaattttgtctataaataatacctatatagtacatctactctaacgatatcccataatttctttaactggagcccctacagatggggttgtatccattttttattttacaaacaatactacagtggttatcttatatacaaaagcatttttggaagttaaattccaagaatgaaattgctgggttcctctgtctttcttgatcccaattccccagccacgtttccctcccccatacctctgctccagtggccacctcctctgcagctccagacatgacgcccagtgtgtagaaggagaaaacgcatagttcacgagtacagacagctggctgaaaggatatattaaacagatggtggtgggatggggtgtgcaataaggtgtaggcagagagggacagtcctaacctcagacaactctaaaacagggtaggaatttgaggccctctatatcaggagaaaactaccaataaagtcttaattaaaatgccttactgataagtttgggagttaacactgtctcccctatgaagccttccctgatcttcctatgaagtcagatgttctctcacctgatttttaacaatgctaatatctcttctataaacttaccatacattgtgatttgtctgtctcccatctggacttagagtccttgaggacagcatcatatccaatcatcttggtcaatatctgatccccatttttaaatgtcaggtggactctatcctaaataaatattctcatatcctcatctctctaaacagtactgctgagacttgttttctgagaaaaatcaacaatttctagagtatcagggtgtacagacagaattttaccttgaccacagaccaaggaagaaggaaataaaggagaggagtgaaggggacctggttaaggaagagggtcatagagtacggtcctataccttcagcatagatccattttggaagacatgctgctcatcacacaccacacagtactcattcaatgttggaatcctctgttctgcatacttcatgatctgagaaaacaacagattctaagtcttttggaagtactggcacacacagatatgggaaataatttcagcttttttttccaactaccctccatcctcccagccccgtgcctaaggtaggatatattcttaggctgtgtacttaaactgatggcctgactgcagagctaagactgtatggtatagtaaaaataagaacatgatgtttgattgagaagacctgggttaacactgtacttctaatacttaatggcatatataactttaagcaagtcagttaacctgagccttggtttctttgtttatatagcacagcattattcacctcataggggtattgcaagaaatgagatgatgtccatgaaggcattttaaaaatataaaatggatgctaatcaaactattaaaagtacttgtaattataggctgtccctctgggataggagagcattcaatcaattagatggcagaaggtcctgagaagccatttcaactacctagaacaattagccagaccactggtcaaaactacagacaattctgtgctaggaagataggaaaatccagagctaatgcagcaatatcctacagcgttttttttgttgttgttgtttgtttgtttttaatgacaccctgtcttaacatagcttttgtgcatcaatcaagttgttcccctttcacatgattttaggctggtaatgggacatgcaagagactttattcatttaatgcagatttactgaatgcccattatgtacccagctctgtgaaaggtcttcttgattatgaaataaaattaaaggttgttttctcagaagctgaacttcaataggagagatgtggcatgtttataaattaataacaattcaaggcagcccatagtatgtgacacacaggtgccatatgaaacaaaaacaaatcgtaacagttcagtgaggggagacatcacatctagttaatgcattggagtaatggcaattttatggaaaaggtgccatctgactcttgatagcaagaggaagataggaagaattacatgaacaaaggttaacagagatgcaaaagtgaaagcatgcccagggaataaagagattttaaaaagcaaatgaccagtagtagctgagcagtgaaagggggtctgtgaagaatactaaagatcatttgagcaagggctattgggaatcattaaggaaattagtgtcaatctcattctcatctcatgtcatatgagtctcgacactcatacacttaaaattggcggtgcctcattggcacttgatcataagtggtaagtattgtctttctagtaatgctgtcagtttcttgaagatgggaacaatgccttctttccttctaccattagttctggaagcaaagcaattcagaaagtatttgattgaggagctgggaggtgttaggagaccaaatgggtcagacaacagggaagggcttcggagtgacaattttgacttgattacctgaacgaggaatccatactccagagtgggaatgttcttgcagtgaccactgacctggtgagagtaaaaagacagaccccgtgaacctcctatgaagctggggcctagacagacctgactcttgcctatcacctaggactctcctaaagcagctaaaccctagctcagaatcccgaagctagaaaggagacttttagacatttttgccaaaggttctggaaaggggctcacctgtccttaaccctccttcaaagtagatggaataggttagtacagcagctacagttaactacagtcctactcacaaactaataaaatcatacatgacttctccttgagattcccatctccagactctgtgcttcatggcctatcagagaagctcgctagacaatttagacataagttttctactgttaaaaaatgttttccagctgggagtggtggctcgtgcctgtaatcccagcactttgggaggtgaaggaaggcggatcacttgagctcaggagttcaagactaccctggccaacatggcaaaagcccgtctctacaaaaatatgaaaaattagccagtcgtggcatgtgcctatagtcccagctacttgacaggctgaggtaggaggatcatgagcctgggaggcagcaactgcaatgagcagagatcgccactgccctccagcctggatgacagagtgagaccctgtctcaaaaaaaaagaagtgttccattctactcactcatggtacatacctaggtttgatttatgatgcctagacaaccatatccccaccccattttgagaaactacactcccacagttccactcccaccctcctgatagccaagtcaaaccctccccagcccatgtaccaaaggagaggtccgtgctgggggagggaggcccacgtgctgagggcacaggagacctgcctgggggctgggagggtagccaaacacttccactttggggttcttcatggtacaggagatggaacggttcatgaggcgcccaacccgaagctctggtacacctagtttgcctttcagcatggagtcctgtatgatagggaaactgggagacctgcagagagagagcaaagagaagtgataaaactggggatttcataggatccctggaggggactggagataagtgagccctaagccaaaagttctaaactaaagaaagacaaactcatatctgaggaaagttgcattgtatcttaaacactattaaaacaagtagatcacacatctgaattaaaatttttatgtcatcatctgtgggttcttcacattgggacactgagggtgggcagaggcagaggataggttattatgtttctaagccaagtatggaataatcccttggaaaggctgcctgtttttctgagagagagaaaaaaaaatagagagagagattgttaaacactgcgctaggcaagaagtagttgcatcccaaagggcgtaatattgactatctgactgtcaacaatgattcctgggaagctacaaatctgggtttgtgtctgcctttgggaatatcagaagacaccacagggggaaaatgtagacctggggtcaaagaatggagcaatatttatttccagaacctagcaaggaattactgcctgttctctgacactttcttcttaggatggggaaacggatcaggacaaaagaacagaaagatggaagattcagcatacatttctccaaatacatatcacgagctaggtattctgttttacataaaggattaggtattaaccttggataaggagtagaaaggtaaggacacatagggaacaggaccatgtgagtggtgtcagtagttaaagagacagaattcagggaagagaggggatagaaacatttatgtaatcaagaaggtgggggtgggggctatcacaaggtgtttacagatgatcagctttagggagcacttacttggggatgggtgaaaagatgctgaggccagctcggaacttcttgatggtaccacttgccttgaaccaactgtgcctcttctcctgctgggtcttcaagaaatcattgctcagatgtttccattgttgggatgtaaacatacccaggatcctgagggatcaaaaagaatgagcttaggcaagatgaggcagggtcaagaaataaggactaaagagagacaaataatctaaaattcagacccaaggactgcaaagctagttgtggtaggggaatgtgtatctgaagacccctttaaatgaccttagtaaataaaaaaatcaccatcccagagcaccccttcaccctagagggcacctagcctaatggccagaaaaattcagagatgcgttgcctttagagtgagatttcaaaggtgagccttcaaaggctgcaaactttgaaatctattgccaagaatgactatactgttgacagggaaacagaagtggtaggatggaggtgagtaccactttgttccttgtgagtcatgaagaaagggagtagggacataaggggtactgacattgttaggagaaaaattatattctcaaatttatggtttccaatttgagctgcgcccttagctagatttgtcaatcctttcacttgtccttgatcagttctctctagcattactctaaggtattgttctaaatccttattaccttctttaagttactaacttcatctacaaccaaaaacctctcttccttcttaagccatcaggtatcagttcccttaattttccaaccctactataaaatctacttacatttccaccctaccttgatccctccattctctggaggtaaggtgacccttctacctaagatcaatcctttgattgcctttttagggaccatgatgtgtcaatcattcccctttcctgtcagttcctttcccaaagtcaacaaaagatgtcaactttctgcaccttagtctagttaacctctccctgttgccttcccatccccatacaaatttctcaacccatactcattgtttctatgttgttgccaaccactcacctccaaactttctgtattctggttcctaccttcaccactataattgttctcatcctgatgctaaatccgatggaaactcccaggttcttctcttatcttctctggcatctggccctccttgcagaacctgccctcctttgtcttctgtgccaccattatcttcctattctactctgacctacctgcagtgtttcttcttcctctgcctaccctgctggtttctttgggatttcatctgagtgtttaagggtattttgtccttgatcctatcttcttttcccactatcatgccttcctttggcaatctcatattcactgactgtaacttcttcccacacacattgatgcatatcttcaaccctaacctctcctttaagtagcaaattgacatatactctggtaagtagcaaattgacatttcggataagcatctctacctgcatatctgaaagttacctttaaataacatgtcaaaaatggaactaattacctatcatcatcctacaaacctgctcccctctcatatccctatttacattggtggtatcacaatttacccagacatctaggctggaaacctaaatgtattttccactactctttggcccttatggctatattcaatatatctaaatcagtcttcaagtcttattgattttatatctcacaaatctttctaatctgtctctcatctccattctcacctataatcacactttagctctggcctttagcatctcttgtcttgacttttacaaaagcaccctactacactagttctggtctcttgtctcatcccctcctacccattttgtataatgctaccagaatggtttttaaaaataaatctgaccacgtcatttctttccctaaacccttcaatgttcacactgcctaaaggataaaagtccaagatcctctctaacttgaacccttccctattctctggctttggctcctacacccccagcttgtattttaccagcaatatttaactacctgaagctccctacacatatactgctttatgtgactaagcccctgcaaatgttattcaccctcagaatctgtctacatggacaactcttatccatccttgaaaattactaatcattggctgggtgcggtggctcacacctgtaatctcagcactttgggaggctgaggcaggtggatcacttgaggccaggagtttgggaccaacctggccaacatggagaaacccccatctctactaaaaatacaaaaattagccgggcatggtggtgggtgactgtaatcccagctacttaggaggctgaggcacaggaatcacttgaactcaggaggcagaagttgcagtgagccaagatcatgccactgcactccagcctgggtgagagcaagactctgtctccaaaaaaaaaaaaaaaaggaaattattaatcatcaccctttcaacagactgagtcactcttcagtgtcctttctaaaccttacatattcacctgtattagaatatgtatccagtggactctatttgaaacttcactgagagtggaaaatatgcttcatttctttgcataccaaatacctagcttaatgctcaacacattcaataaactagagttcctagagacttactctgaagaaaccactagagaaatatgaatagcatgactctgatttcagggtagtaaaaatgctaagtagtgatgagcctcttttatctctagaaagtctcagcttctgacacccaagaaccacatactctctctccacaagcttaaatctggctccctaaatttattttagcttttcctgggcatatttcagaaagacatttttggaagggggcattccatccaaggctctgcctgtccatccatatatttccacctctctctccttccttcacatgtccatgaccagaaaagaccaaagttcttactttttcaactgaagacccagcccaaatccttccttatttgatggctggaaaacctcaatggatggttctgcaaagagaagagaaggctactagtaagtacatatctcttgtcttcctggagtccaaagctcagtggaatagcttccatacattctaaagatcatagctgctgggtactctaaacagtaacggtggaagaaaaaaaacatctgagggagagggcagattctcgaagctgtcatatgaatctgaaatatcctcaggaggatgttgagaaaaggaggagaaagaaattttatcttggaaccagagaaaacaatgtcattaggcaagaaggcctttagggaatggttattaggtgacaggggatgaagataccaattacaggggactaaaaagcccctaccaatagcctgcagattgagcccaaggaccttgttcctaatttttttctacctcagttaacttagggctttggattagaccacactcagaccacccacttgcccaaagtcactgcctttacctggtccatctaggtactgggagagagaaaatcgcagcctcaacacaataggttctgtccggaggaccttccaggctgtagagacttcctcctaaaagaagaagggaaatagtttccagtttagcaacatagacgaatggacctgaaatttcccctatatgacacacacatgcacatgacagtacacaccactgtctgctgatggtctaggaaagacagagatgaagaatatgtgctccaaatacagcactcgggaacaagactcctggcctacatgacaaattccacaagtccagctagacatgttgttggcaggtactagccccacttacatcgaggaagctgatgttgatgtggaggtcaatgtccacgtcatcgatagttccatattctctatagagatacaggtgacaacaggtgagactcattaagggagaaagaagggaatagaaactgagttggaaagagaactgagcctggggacaggggaaagggaagagtggatgacagttttgtacctagggtcttagctatagccttacaccacttacctgatcaggatctacttccaggccaaaagcatttcttacctgaaaggtgaaactactggcccagaggggtctaggataagagggaattcctaagaaaagtggccttactctctactctcagccaagctcatttattctgagcattttctatcattaagttcataatttatcccactatcataccataaaaagaaaaacctctagccttttaacaactcagaaagaagtgacttgctcccctgccacccctgaagtagagtcccacctgatggatacagagttctcactgtagatctccttcacggcttcaatgtctgcatcaagctgtgggtgtcgatacaggtcagctgcacagctcccctgagatagcagcaaaaatggtggtggagagaggtggaaaaagacgagggaaagagagagataataaaaagaatatgaaaagacaccaggaacaggagaaatcagacagcagtataggggaagtaaaagccacttatgtgaaggggttctcagtggtgaccctagcaagggatttcattaacagaggtctccatctcatcatgactttaaaaaggttcagcagaccaaatgtaggcttttgcttggagttcacttccttaaatctccagcttttctctcagaccttgaccaggataccttctatgacaactcagaacaggctgaagagttacaggtttcctaagattggttctaagtgaagagcattctgagagtctgggtacttctgctcaggactgtgccctgggtagtgatggcattaagcaaacgctggcagagtaatcttttaagatgtgaccctaatgaatgaaactacccccactggctagtgttataaaagtcagaaaataattatgtctaattaagatatgggtagtctccacatacagaggatgtagtttactctggaacaggtatgactccaaagaaagagcaagggcacgggatcagctctgacaagaccatgctcagaccacatcaacattataacctcatctcatctgtgctccagaacctctttcactcctgatgtatccaaaaagcagcacatatctagaccatccaacacgggggtcttgggagatgtaacctcacctgaacgccatagagaaattcctctgattcattatctccctccgagtcgtcatcattccagaactggcctttgatgtcctagtggtgagaaataaggatatcatgctttgttaggtccctattatcccatggaaaggcgtgggatgatatggtgaggaacagattcccacaaagattgggaaatatagaataactgaagccctgatccctttacacctttcatgtcaccctttgtgagagtctcagtctcttcctgatatgatcatatccataaactagctcttagtgggacagaggaaaacatctagggaattttggccttctgaagtctcagtatgatgactgagaggctctggtagccagtaggaaagaaatgcaaatgacttcaatgtcaaggttgactcctaagcatatctgggttccagtacaagctggcctcttccaggatcattacctaagacagttcccaagcacacctaaactctcttgtctcattattttctttctatcctttaaagtacttaactctcctctccctccccaagaaaacccactacacaaacacaccaagtaatactgtttctgtgccccttccctttcctttaacttcaaatagccactctatcttccaaaagggtagaagggaaaataccaagaaagggtgagatctgcactttgtctcctctaccctttgaacaatcagttggagaggtgggcagtcagttctcaccattgggtcagtgggtcacacacactctcaggtcagtgctaggcagcacccctccataccactagccgaaccaaggccaacgagatgggcatttaggagaccacaaagggagacaaggtagggcacgatgtcagggacaactggtgatctgttggggatggcaggctctgctgttgcggtggtaacaagtcactgtcctgtggaaagtagataataatgggtttcatcaccacttaatagctgggtggtgtatatatacaggcacacgtatttatcaatacactttttttttttgagacagagtttcgctcttgtcgcccaggctggagtgcaatggcgcgatcttggctcactgcaacctccgcctcctgggttcaagtaattctcatgcctcagcctcccaagtagctggaattacaggtgcctgctgccacgcccagctaattttaatattttcagtagagatggggtttcaccacattggccaggctggtctcgaactcccgacttcaggtgacctaccggcctcggcctcccaaattgctgggaatacaggcgtgagccattgcacctggctattaatacacttttattatacatacagatacttgcatataaaaagacatgcttgcgtgcatatacatgcacacttgcacatgcagttctttatagataatgaaacacaaaagcactatatgcaagatactgctgttctacttaaactggagagctgggattagagcaagatcctgctctagctcataatgttacaactcctaaagccaaaagtgatggtggcaggacaagatgcttatgtttactctgtcagttaattcttcagagtaccaactcacaccagagttaagattcagaatcggattatttctggactctttattcttagttatttctccatattagccagtatctctctttaaacatcagtattactagctattatacggcaacaatagctaacttaaaaagtcctcaacggccagatcacctgaggtcaggagttcaagaccagcctgaccaatggggtgaaaccccgtctctaccaaaaatacaaacttagctgggtgtggtggcgtgcgcttacgatcccagctactcaggaggctgaggcaggagaatcgcttgaatccgggaggcggagattgcagtgagcctagatcacgccactgcactccagcctggacagtaagagcaaaaactccatctcaaaataaaaagtcctcaacaacactgaacatcttttggcagttatggtctcagttgtcattgccaaaataatgccctaaagtcatcttggaacctgcttcccaaagaaaaatgcaataattatcccaaaaattgcttagaaaaacttttacttaacccagagccctttcatacacaattccctgctcgcttctaatcccacagactcctaatcctataccagcaacttttagctccattaaaacctccacatatagcagaaaaacaaaacaaaacaaaaaactcatctgtgaaattatgaaggctttaatggctgaagatggcaaatctaccctaaaagcaggctaaaaaagctttctgttgctctctagaccagcaagtcactggctttgcacacatcgcagctgaagctactccaacctcaaacagaggtgttcttggtctctaacacagttcttcttcttcttctttttttgttttctgacagagtttcgctgtgtcgcccaggctggagtgcaatggtgcgatctcggctcactgcaacctctgcctcccgggttcaagcaattctcctgtctcagcctcccacgtagctgggattataggcgcccgccaccatgcccagctaatttttgtatttttagtagagacggggtttcaccaggttggccaggctggtctcgaactcctgacctcaggtgatccacccgcctcggcctcccaaagtgttgggattacagatgtgagccactgtgcctggcaggtctctaatacagttctactgaatgtcaggtttccagattagtgattctctgactggggttggtggacctacagcatcagtatcatctaggaacttgttagaaatgcaaattctcagactcctcctaagacctactgaattagaaactccagaaatggccaggcactgaggctcatgcctgtaatcctagcactttgtgaggcccaggtgggcaggacacctgaggtcaggagttcgagaccagcatggccaacatggtgaaactccttctccactaaaataaaaacattagcaaggcatggtggtgcacgcctgtaatcccagctactcaggaggctgaggcaggagaatcacttgacctacggaggcagaggttgcagtgagccaagactgcgccattgcactccagcctggggggcaacagcaaaactctgtctcaaaaaaaaaaaaaaaaaaagaaaaagaaaaaaagaaattccagaaattggacccagtaatctgtgttttaacacacgctccaagttgttctgatgcataaaatttgagaaccactgttctagttctagatccttgtgtgttctaaggacctgtggttcattccttagataccaacttaagtctggtaactaagccaggatggggacaaaagacaccatgccagagcagagccagcataggagtcttccagctcatagtgttgcctgatccttcagaaacaacatgcaaacggaaagtataactaaagttcttagagatggaatgacccgattactgagatttgtttaaaatactaccctggcacacacataaaaaaaggagggaggataacagatgaaataaatacagcaaatagcaaaatgttgattactggtgaagctatgtgacgtacatgatggttttctggtaatccctacctccctacttttgtgtaaagttgaaaagtttcaaaataaaaagtttaaaaaaaaaatcagaagctactctaatgggctgtcctcaaagtcaagtctaaatgttaacaggaagattaaccaacactccacaattgcctcattactgttcttcaaactcatcaagcatattcccactatagggccttcatcttcccaccatattcccaagcatattcccgccatagagcctttgtccctgctgttcccctttcttggaatgctttccacccagatatccacatggcttgttccttcactcttccagatctctgctcaaaggccaccttgaccatcctatttattaaaacagaaacaactcaacacccacacactagcactctctatctcccttcccagctttatttttttccacttaccatgttctaacatataaaatgtttatcagaatgtaacctctggtggcagaggctttgactgctttcagtctacattcttagtcccttaacacatttcttgaatgagagaataaatgaatgaaccctctgctggatacttaagtcaaatgggagatatatacaataacctgcatgtttctacacatagacaaaaatcacacaaaaaaatgattttaaaaagcaaaacttcaccttcaagagcagctgagatccagaatgtgaagatcttggggtgaggttcgtgagatttgaaaataaacagtcaagtgctgatctggatgatcacagaggaataaagagggaggcactaaatgtccagcctgggttgccctggggtgaggggtaggatgacggcagcgttaggccagaagtgccaacttttcacggtctttgttgctgcagaagtcaagaaaaatttagcctctttccaagggctgttgctgcttggtttctgttgctatcacaaggagaaaaaggtatttcagagggagtttttcttgttcaagcaagagacagttcagagattaccggctttttcaaaccaggctgctttagtgaaagggacttgcttcctctactctcaatgccctttcctctggagagatggaaagtggatttaaaaggtgaagagttggaaaaggaaggtggtgggttatggaattcacaggatcacaaacactttttaaaaaattagccggaaacgtggcctaattcaaagctttcatgttacacacagaatacttagacctacagaggtcgaccaatttgcttaaggttaggagtacagaaggactgggatgtaaagacattggacaggtcctaattacatctaatcttcatgtgatgtggttataattaattgagttgttaatgaagtaagcaagaaagacctatctgatttatctaaatgaggtaaagaatgggccctttcaaaagaagttgggccaaaaatagactatatgatgagtgtccagagaaggtgttaaaactcagcggctaatatagaacgctttatgagtttccacgagaataagtcaaatgtaaatgagcctcaagtctggatcacaaaggtctttccctaggtccatgggcgcttctctaggtgtgacaacttcacgtctagtcaaagcagcttcagagctcaatgtttaaattgtgggttgggctcccggctttgtggtcctggaggaggttactccactccatcccgtgtgctcccttctcaggagtaggccactaaacaaagactactaggaagaatcactgaggggcgactcccgcaggttagcgctatctcgggcaccccgcagggagagaggacacggctgccccgcgaaaacactctctggcacccgtgcttccaggacaggccctgaggcctctcccggggaagcagttacacctgttctccggggctcccctgaagaccccaaaaacacccaacacctgcctccccaggaaagacgctctgggcccgatctatgccgcccggccgccgggcctgagtgaagcctgtccagcctaggaggggccctcagaacctcccggtccaagcctctcacttcgtccacccctgcggagacggggcgagccccgcacccttcccgtggcccggccgcaccgccctgtgcccgtggtggcggccacacaggccagcctggcgagtactcacggcgaccccgggccgcgcgcggccgcagccgacgggacgagcggcccgggacgccccgcgggggcggagcggcaggccaaggggcgggggccgggcctggcgggcgaggtcgcgcaccccacgcctcgtcgttccgtcacgggcgcgctcagccactctgcgcacgctcgcgcggtgacacgatggcacgtggcccgctcctgaccaacagcctgacggcctgctcctgggcgcgcctcagcagccgacgccagccttgagacgcctgcgcggcggtcgctagtcgggaaagggtgcggagtggggggtggcgcctgcgccgtgggtaggggaggcagtggagaaggaagagggactctgggggagtgcggggagccttccaaaggagaatacttgcatttagcgccccgagtggttgggaggaacaagcaggaagggcaacccaggttgcctgtaggccgggagggagtcccctcgccggaggttggggccggcaggtagagactgagggaagtcctgaggccttgctgactgcaggattctctggttcgacaatggaagtcgaacacctcgggcttttaaaaattctggcatttaactcatttgttccccggtagctgcagcgtgatggagagcaccctggccttctagtcaatctgggtctgaagcttgggttcggcacttattgatggtgcagccttaagcgatgactttcactttgtgaatctgatttctcctctttgaggtggagacagtaatatgtgtttcacggagccgttgtggtgaggatgaactgagatagtgttaggttgaaccgtaggaaattgctatttttgcagtttataaacagtcagataccttcaatttcatacgattccaactaatccatgtaaagtaaccagcagagtacttgggactaggaagtagttcatacatggaagctgtaattgtggttattgtggttattaaccctagacatggccagatctccttcatccttattagtcttggggcttccacgtgaccctcttttccatcaacactaatgggaaaaggcttatcttagacctactctgtttcctcactccctctttgtagctggacacagtacacacaaagaaggctttggccctgaatgatataaacacgtcatgtctatccctcctaagctggcctcagaagtttcccagttaactttttgttgttggttgatttacatttgcacattctcagcctctcctttctaactccttccccttttgatgtccccctctgctcaccttgccactcagcctgggccacaacaccgtctcggtgtgagtttgttacatctactgcttatagtaactgaaaaaagtgagggatcaatataacctcggtttcagagtgcggaagttcagagtggtaggggaaggagtcaggcctgctctctaaaacaactcaccatcaagggccccgtaatagcttttgagaaccaagtatgtatgggagtgtttgaacataagcactgtgcccatgagtgacaagtccaactccagtattcaataacctttaggattccccctttccagcataccaccactagctcttctattcatcatgaatctcagccacctcatagtttaccagtatcttccaggcttcacctcttttcctacccagtccacatccttggtcagtcattttaatcacatctttgttaatatgcttgcacttactctgtaaaaatcacactcctgggtcatgccagctatctaccttctctactctcccatcctaaaccaggataaaggaagtcatccaatcctgcacacttaagcttgtgagtggacaccatttaggttagtctagcccatgaaccctattctgtgggaattatcgtttccacacccacactatggatccacaggccccagggccatgttcgtcttgtgtgacctctagcactttagctgcagtttattgaactgtgagtggattcctggtctaagctgtgttaaacagatgttctcctgaaaatctgggattagagctgacagattatgattctaactggactggtttcttaagcaaaagagacatagacttaggagctatggtacatctacctcccacctactatgatgaatgagaaaaggaaaaagaccatctggggacacagaatgaagcatggagaggcagagaccagaaatggtgagactactctctgctttctggcagcttcccaggcacccctcccttccttccttcttttttttttttttttttttttgagacagggtctcactgtgttactcaggctggagtacagtggtgtgatcatagcttactgcagcctccaaggcttaagcatgcactaacatatctggctaattaatttttttttgcagagatggggtctccctatgttgcccaggctgatcttgaactcctgggcccaagcagtcctccatcttgtcctcccaaagtactgggattacaggtgtgagccactataccctgcccaaggcactttctgaggccctctgatcttgagggactaggagtcagtttttatctaaaataaatggcttaagctaacttaatgtgcactcagtacagagctcctacaaattcattgtctcctcagcagagtcctcagtgtacccagcaacccttcccatgtcagcctctcccaccatcccccattctgcttcacagaaaaaataaaggctctgggtgccaggtacttgggtggctgaggcaggaggatctctggagcccaggagttcaaggctacagtgaactgtggttatgccactgcactccagcctcagcaatggagcgagactccccatctctttaaaaataaataaataaataaaaggccacgggggaactgcctcaattttctgtcccctccaaacatttgaatctctcccatcctttctgtttcagaagtggagagggctctcttcaaatacaaagttagtcctttcactgtgatctgtatttcattcctttttgcctccttgggaaatttgctccttacctctctctttcatttatattcaactttttcctctcccctactcgttgatctcagtatataagcttgatcaactagcccaaccgtaaaaagaaaatccaatttgaatcctatatgccatgctactgatttttcttgcctttaaccaaacttctaggagtagcctatactccccctctccactttcttgtcttcagttgttccttaaatctggtgtcatctgacctctccccaaaatttctactgaaaatactttcaccaaagtgacacatgacttacaaatggacaaatccattgggaattttcaggcttcatttatatgaccacacagtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgtcaatcatcttgcccctgcagttgactgcatggtgtcatttggcattgttgatcatcctgcccctgcaaccctttcctctgttggctcttatgggctacactcttccagtttcttgctacacctcatatgactccttcacagtatccttattatactccctttccttcattccctacttaagtagaaaagcagttcagcccacatccatttctcctattactcttccctgtggcctccatggccacttgaaggagatcttgataatttggggttgcccagaaacagaatctccttcttatgttacaagttttagaagtaagcagagcctatctttcatgacagacactaaaaaggttgaatctttgctttcccagctctctagctaagacagaggcatgtgaccttggcctggccaagcatcttccagaaatgtagtttctggagtgactcagagaaatagaatcatagagaattcatgccagtggcaatggtgacaggagagcagggtcagctttaccccatgcccagggactttcatggtgtgggtactggtagtggtgacatcccatgtccaataatgatgacagcagcagtggtcttgtggagctggttctggcatctgaatttggcctgtgctgtggtggactggcctctcattgttcctgcctattttccaagcttgggtcttttgcctggcaatcccgtgacccacctagtgccctttcaacaaaagtctcatttaaatccacctgagtgacacacagttatagactggaactcccaaatctatatttccatcctgtacttcttcttcttttttttttttttttgacggagtctcgctctgttgccaggctggagtgtggtggcgtgatcttggctcactgcaacctctgcctcccaggttcaagcgattctcctgcctcagcctcctgagtagctgagactacagatgcacgccaccacgcctggctaatttttgtatttttagtagagacggggtttcaccacattggccaggatggtctcaatctcttgaccttgtgatccacccacctcggcctcccaaagtgctgggattacaggcgtgagccaccgcgcctggcttccatcctgtacttcttgagtttcaagttaactttggtcaagttgtcttttggacagctccacttggatgtcacataggcaaacatcttctcactgtatttctttcatgttcctaacttagtaaatctcacctatgacttattcagactgaaccctgagaagaaagcatcttagacttctcccatccttatttaaatggaaccaattttacctcataaactctaaattttacatcttaatacatcttcttcttctttttctttctttccaaactctggcctcctgccctctagctgcctaaaagcacagagactcagaaggcagaacaggccacacgcctgggtctggcttttcccaagggatatcttaggtgctgagcagaaaatgcaagaaactaaaaagcctgtggaatgagcctcagcctcctggggagtagtagacagggtctcaatatgtggcccaggctggtctcaaactcctggcctaaagttatcctcccacctcgacctcccaaagtgctaggattacaagtgcgagcaaattaatacatcttaaatcaatccctcctttatattcctattcctccctaccagaactatcgcattcgcctcctaatagactccttatccagtatctactcctgcaatctattctccacttagctgcttaggggatctttctaaaactcaaatctgatcatgtcactcctctattaaaacccttcaataggctgggcccagtggctcatgcttgtaatcctaacactttgggaggccaaggcgggtggatcacttgaggttaggcttcgagaccagcctggccaacatggtgaaaccccgtctctactaaaaatacaaaaattagccgggcatggtggcagacacctgtaatcccagctactcaggaggctaaggcaggagaaccacttgaacctgggaggtggaggttgcagtgagctgagatcgcaccattgcactccagcctgggtgaaagagcaagactccatctcaaaaaataaaataagataaaaataaaacccttgaatgtctctctactactctcaggataaatacaccctttctatagatataaccctatttgactctcaccagcccctcacatgcatcctacactccagcctggccagattatacattcttataggccatgcaggacatactttgtttttgtttgagatggagtttcgctcttgctgcccaggctggagtgcaatggctcgatctcggctcactgcaccctccgcctcctgggttcaggtgattctcctgcctcagcctcccaagtagctgggcattacaggcatgtgacaccatgcccagctaactttgtatttttattagagacagagtttctccatgttggtcaggctggtctcgaactcccaacctcaggtgatccacctgcctcaacctcccaaagtgctgggattacaggcatgagccaccgagcccggctgcatacttttatactttgtaagtattagtacttagtggagctgacaatcacaatgctacctcctgcccccttctaccccacacaaatggatgcatgacccatcaggccaggcaaaggactccatcatcctgaccaaagtgattagttcaggtgtgggtttgtgacctaagcaaagccaatcataatcttctgctcaaagctctcttgcttttgaggttaatgtgctaagaggatatgagattgaagctgctggcacccagctctccctgccacagggcagagaatggggccaaggcataaagagaagcagagctctgagaaatggaatgagagagacctgatgacattgtttgagcccctgagatgagccttgcctgaggtcagtaataccaccgcatttctcagttctcatcttgcttaagctggtttgtcttggttcctataacttgctactaaatcagacctaatacagaaatggaatgaggtatggaattgatggcactgaagtgaagttgaggcagtggagatccccacttggctggggaactggaaacccctgctatttggtatcaaaccagctggttaaatgatcatctattttatcttgagattcaagtcatgtatccatcaaagtggagatttctgggatgcactggaaaaaaaaaagtttggatgttggagtatgttgacctcttcttgagattttcaataaggtcctccagtttgactttcctccatgctggcagaatcagaacagtatacagctttgtttagagttgacttttctgcttttttttttttttttttttttttgagacagagtctccctctgtcacccaggctggaggctggagtgcaatggcgcaatcttggctcactgcaacctccgcctcccgggttcaagcgattctcctgcctcagcctcctgagtagctgggattacaggcacacaccaccacgcctggctaatttttgtatttttactagagacgggttttcactatgttggtcaggctggtctggaactcctgacctcaggtgatctgcccgccttggcctcccaaactgatgggattacaggcatgagccacctcgcccggccgccttttctgcttttgaccagcaatccagggtgctaaaggtcagataatcatgcatcttgtcgactataaaggccaaatcctttcccccaaactaaagtgaataagaacaaaggcctagaggtagaaaatccagtaggagatattggagtgagtttagggtctgggaagttccagagaaaaaagggagaatcctgatccttcaagctatacctgaatgcttcccttttcacccctccaaattaagtaagatgtatttggcttggaattcagacagtgttgggggttctggtgcctggggactttggctgtgaatcctgtgggagagaattggatgtcttgggcacgaacttcatgcactttcttggattccctagccacctccttctttctgtctcttggttggcaccctgcctgtgctaagtagcccttctacttccatgtctatagtagaaatgccatacagcagaccatgggagctgacttcccaacagccatccagggagcaaatgatgcaactgagaagtgcaggggagttagctccttgtggggtggaatcttggccaacagaaaacaggagaagagagtggaacagaagcattaattccctctcatatctccccttggtgaactgctccaaggtgccatttctcctttcaaacaccatgtgcttggcaaacaagcctgacaagggacgtgctctctcctaatagctcatatgaagtggcggccggcacagtactgcgtcatcttgcattgccttcgtctcttctccctttcaccatcctggacttccacctccctgcaaaatgtcagcacttgcctcagggtctgctttctagagacttgggttaagatatggagataaaatcaaagcccccatctctacattaagtccccatataacataaaggtcctgaggacacagctgagttttcccactcaaatgcagggaatccagcccagactgctggcttcctctcgggaatccagtgtcaggtcactgggtcaggccatctcgggactactccccaggaggctgaggctcattccacaggctttctctttactctcttgcattttttgctggtcacctaagatatcccttgggaaaagccagacccaggcttgtggcctgttctgccttctgagtttctgtgcttttaggtaactagagggcaggaggccagagtctggaagttcaaagtcccctctacagatggccagctaaaggctttggtcagcccaggcttctagagggcagaggttgccataatagctgtgtctggagttggggctagggagacaaagagtggccctctgccccttcttagtttgtacttggcacagacttggccacctctttgcagatcccagctggctcgggctgcaggctagaagggcagctgaatggcccacattgcctcttagctccctgaactcatgcagtttcttccaaataatacagggctgtgtaacataattgtgcaaatatactggccatgaatgaggctcagaggccagaaacagcctgtgagtccctgctgggtttggctatgtcatgatggaggcaagtgcaatcaggacagtggctgctcaaagattacagcccaagctggaaaggatcaagtgagattctgtgatctccacatcatagcaccctcttttggaaggtattacatgcatgttctgctccactgaggccagggtgagcccccaggtctggtcagaggacatagcagaaccagagctgcttcaaggtcagaggtcaccagtcctatctcagaccagaggacttttctccctacatccaagacacccagattgcatccagcgagagaaattcattctaggggatctgctggaggctgaagactctgcccagagcccctaagttctagaggttgtaagagggcccccaaaattcagtgtcaactgagagactcccctgaggagtctttcgattgtgtggcctcaatgtaataatgggccatggccagagttggaggagtagagcaagctgcaggttgctggtccaagagtgcttgactggttgcttccatcctgtcctatgcatctccttggggcttgaggcctaggagccagtactgctcaggtattttgaatatctggtcaagaccaaggtcactggagcgtgagtcagccaagtgttgaatgagtaatctctctttgggggtagtgagcagattaaggttgacttaccactatagacagaccattatggaagccacaaagctgagaggtaggggaatggctaaagtgtgacctcttgctaagacgaagaaatcacatgagctaggattgaaactcatggagcaggacattatcaaggattcctcatgatggttaccagctcaaagaaagcccacgaatcagagaatcctcacaactgacaaacaaagatctgggaatgcttaatctctacgtcaatctttaaatccaaaactggctgggcacggtggctcacacctgtaatcccagcactttgggaggtcaagggagatgtaccacttgaggccaggagttcaagaccagcccgaccaacatggcgaaaccctgtctctactaaaaatataaaaattagccaggtgtggtggtgggcatttgtaatcccagctactcaggaggctgaggcatgagaatcacttgaacccaggaggcagaggttgtagtgagctgagatcacgccactgcactccagcctgggcaacagaggaagactgtctcaataaataactcaaaaccatgtcaaaagggaagtgggatgcttcagttccaaaggtccatcctctcagggatgtccataaacaacaatggacaaaggagatatgtcccagtggaaaggaccaaaaacaataggttttgttggccaagaaattcactccactgtccagaaggatgtgttatatgctgtagattagtgaccattgtattctcttctccctattccaaatggaaggtttttaaataactgttatagcgaggtgcagtgacatgcacctgtagtcccagctagtcaggaggctgaggtgagaggatcagttgagcctaggagttcaaatctagcctgggcaacatagcaagaccccatcttaatttaaaaaaaaagaattaaaaattattcagtggtgtgtatttgtattcccagcttctcaggaggctgaggcaggagaattgcttgagcccagcagttcaggtccagcctggacagcattagcaaggccccatctctttaaaacaaattgtgatcttctttttctccttatttcacattggttatagggcaagtatggggtagctaagtttatcttttacctatagatggcaaaatcttaagaagtcatatccagacctgagcaagaattgcccatcaccaagggaccctggactgaggactcaataaagcaactggatgtaattctgttttatctccccttgggaaataggtgaatgtggtttttgttgggtctatgattattgcattgtcaggcaggcacatttttgaaattgtatgtttgtcaagaaaagtataggtggatgcaataaagggtgggatatagtgggtgcatttcatttatctgcccatcatctcttccttagggacccatttctccccttccacacagtcctgatgaagttgtcaattatggtggcctactcttctatcctagtggtgggcatgtgtccaaagctggccaaagtcctccctgggattttagaactagaactaatgaggccaacatatggaaggaagcagagccaagagatggagacatcatcctttgaacccctagatccagccatgcttcaaggcagatacatgctttgatttatcagttatgtaaatcaattaatttccaattggcctaaacatgtttgagttgggtttttgacacttgcaactgaaaaggtccagactaatacatgcacacagagagacacaaacaccatattgttcaagctcatcagacattatataagtcttccatgatcttaccaggggtcagcaaactttttgtctaaaggacaagatagatagatattttaggctgtgtgggccatatgtggtctccgtttcactttcttgttttgttttgacgacccttcaaaaatgtaaaaaaaattattagtttggtagttcatacaaaaataggccacaggccagatttggcccacaagccatagtttgccaacccctgatctagaccatgtcaaaccctgaagctttggaatcacacagtctgccagtccttagcccatactctaaagtatgaagccagatattttaaatgtcattttggttcaagtgtcttgacatgacttggtaatggtaaggttcagggtagagttaggaacgggaaaagggtcttatcttgtgcccattatctgccatataacaggtactgaataaatggtaattattattatttcttggtaataaagataatttttcaaaatgatgcagctgtctaaatggctttgtccaaatgtcccagttcatccttgaagacttttccccttcttaatctccttcagaaagtatttcacagacctcccccaccaataaagtctgaactaggtactctcattcttgctagcacagaccttctatggccctccattgtaactggattatttgtctctctttccccttaactctgagtactttgaacatacctgagccccgacacgtagcacagtgcttagcacctagcctgaggggactctctgcttccatgtgaatattagtttgagggtgcgggtactgtgtgtctctatttgtgtctagggtggtcactctaggtgtcagcattgtgctggtgcacatacaccctctggttcttccctcggttggaaaatatttgtggatgtccatcacaccttacctggtaatattactgccagatctatgtttcattcccattccctccaaaaatgagtcgaagacagaagaacaggtgggaacaagttttcttagaaactgttatgaaggaggagccctccacccccacccccacatcttttactatctgacatgttatcagatcagaggccttcagcctcagcaacatctggggattagagggaccccacacagctggggcctcagaccaagctgatccatgcctgtggggtggaggggaaatcctcctgggaaaaatatgtgcaaggccctacaggcccaggaaaggctgaccaaggcaaggtgagtcatggtgttctaagctgaatcttttgcccatctcacagaagcaggcaggaagcaccaccattgatcagctttatatggcacccactgtatacaacagacagacaaagacagacagacagagcacacaccacttctaagctcaacactgctcaccaactagaagcacctcggttaagcacatgtgagacactcttgcataggaaagatgtagtttttaaaggaatgaagaagtattttggcaaaacatctacttccctcccaggtctggggtaaagagggacctctaattctgaagcttctacatattgaaaaatttccccttctcaatggcagtatatacagtagcaaaccttccaagtctgttgtcacagccctctacagatatcctgaatctactttacaggtgggcaaacttagactaagagacagaaggtagcctggagcaaggggacactgggactggttcaaggggaagggaaacaggaggtgtctcagctcagccaaaggcagggcctctgtctacctggattggcaagggaaaggctcaggtggccagaactccctctttcttcccgcctggggaagcagtggttccacaggaaaggcaatcccactcttgctggctagggggcctcccgggatggcaaaggccagggccaacctgagctctgcctggggcctcttctgggatgcactctgagtttggggattgtggattgtgggttcactgcttccataacgttctcattacctgcatgtgagcctagacctcaaatccttaattatttttaaaagggcagggtgggggagtggcttaagagggaatgagacacagaacaatctttccacagcccccatctgcctaggctggggctgtcaagggtctccttcaccctgtctcctagggatatttaaaggcagcttttatgagactctatactgtctttttttgtagttgtttgtcttgttttttgtttgtttgtttctttgttttaatttatatagatatatatattcttaaaaaagcaatagtcctttggtccctaaactctaaggaatgatatgattttgaaagaagtaaatctgggcttcccttgcggagaagcccttggcacccccaacgccctctgctggttcccctggacagtcactcctcaccagccctatttgctctgccagcctgcgctctatgctgcaggcacagaacaacccacttgataaaaacaatccttagagtggccttagccccaggcaccagccttgggtccgatccacctccgtccgcagctgctccttcgggaagggctgctcaagcgtttctgtgcttttcctctcctttcttctcactcttctgtttctgttgttgtgtattaattgataaggagagataggggggaaaaggcaagaatcaccttggagggcaagaccagaagagcagcttgcccccatgagtgacgtctcaggtgagtggctggacctctcttcctgaggagtagggctgcagcaggacccaggcagcagccccgtccactgaagccagacttgagtcctgagcaaaagaccccaaccccacatcccctctagaaggttcctggggtagctcaaagtgaggcagggccatgtgggccttctgagacagaaaatctctaaaagttgcaggcagcatcctatggacccatgaccttgccaaaaatgtagaagaacttggcccatctttctccccatcacccaccaggccctgcagattctacctctgaagcatgtttgcttctcttcctccatctccatgttcactgccactatctcagcccttacttctagtcctttctctgcttaagctcctcaacagttcattctcatcttcaggataaagtccaaactcatggcctgaagacccttgaaaactggcccaaagctacttttctagtctcattttccagtctcctggaccctccccgcatacaggttctctactctcattggctgtctctggagtagaactgcttctccaggcagaaagactctgattgtctctcctagactgcggggcaggaatgttgtccaattgatctccttggattgaaggaaaagcaaagtctccatctgaggtttcctcctagctcctggctcttctctctatcccagactttctcagaggtgggtgcctccaaggtcccaaaaggaggaccatcaaagctgggagggcctcatcactcaggcctcatctacctggggtccatcagggactcacctttctgtggctggtcagtgaaagcaggtcagtaaggccggttggcatccttgggccgctttagctggaccttgagcctcttcatgccaatttgaaagccattcatcgcctgaatagcagtctgggcactagttggattgtcaaaactaacaaaccctggagggtgtgggcaaagagattagctggggactctgcctagcagggcctcctttctctctgaccagccccctcctcttccagccccgtcaggccagttccatcaaacacatacccctccactgtttgtgtggatacagagtcataggcagatggcctgagattcctaaaggtgtgattcttggaaggataggaagcaactctgagtgtgtgtgcagggtcagtgtgttgatttggatgtttccgtgtttttcctggcatgggttggctttctccctccacagctcccattctggtcctcagaaccatagttggagttggaggggatctttggtctcagaaccagactcctcctgccctggccagactccaaagctctgacctagctggccacattcctggtggacacatgatcatcccaggtaaacctgaaataaagctcgttctttttttttttttttgagatggagtcttgctctggggcccaggctggagtgtgcagtggtgccatcacaattcactgcaaactttccctctcggattcaagaaattctcctgcctcagcctcctgagtagctgggattacaggcacccatcaccacgcccagctaatttttgtatttttagtggagacgggatttcgccatgttggccaggctagtcccaaactcctgacctcaagtgattcacctgccctggcctcccaaagtgctaggattacaggcgtgagccaccatgcccggccaaggcttgttgttggcctaaacttaggcccatcactggtttgtgaccctgttttgtgccatacattcaatctcaggaaatcactgcattatggaagggcaatcgtagggtctgtaggaaatcctttatagtcagaggtgggagaggcctaggggtaggttctcagctcaccaaaacacttgctctggttggtggctcgatccacaaagactttagcagagacaacggctccaaagggcaggaatgtctgtatgagttccgcatcaccaaactcctgaggcaggtgatagatgaagaggttacagccttcggggcctggaggaacagtagcaagctggttcaggggaaggaccctgagtccagccccaccaggttctgctgtccagcccccagtccctcaccttctctctgctgctggggcagggctgaaggctgctggggaaaagctgtgctcactggggcataggccgacggataggctgctggagacagaggtgggagtggacagtgatccccaggagcccttccccaagcagggccccaactgcctggccgcttttgaccaattcagcccagtccaccataaccctcaccccaagagaggtcgttctgggggtaggaggggatgggaggatcaactccttggaacagagcctaaatcccccacaactctccctatttctttctagggcccttcaacctcccccaggccgcgtagcgccaagtgaaacctgcgtagtggtgcatcccagcgtaggcctgctgcagggggtcagccacgccggggctctgggctggggagagaggggcgcgaggcccacagtgaaggcaagcgggcgagcagagtgggtgagaagctcagggagtgtgggaggtggacggcggctgtgagagacagcagggaaggagggggatctcttcccagggaagccaggccctaaccccccaccccccgctccccactccatttcggggggatttgggcggagcggggggcccacctggataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctaggcctgggccctgtgccgccgccagcagggccgcctggtgctgcaggatctttgagaggaaagatgggcgagagtggagggccaaggggcaggcagctgcccgtgctctcagccccaggcctggcccacccacctgcgcgccctcgcacgcaggtgcccggtacctaccgccgtggtgtaggcgccgcaggcccctagcggcagtggcgcggggtggaaggcgcccaggtggccggccatctgctgcatccgccgcagcgcgcgctcccggtcggtgtccgccagcttgaccacgaggctggacgaggcgccctgggcagggcaggggaggccgtggtgaccggtcctgaccctggccccggcccggggccgagcgcctttcccatcaggtcctttcgcggggcaccgagcacactcggggaggagaagcccgtccccaccccactggcctcaccctcagcccagggaacccgccctcaccgccatggtccggctgccgtgcagaccccggatggccgcctgagcttccccttgactcccgaacttcacaaaggcacagcctggggcaggacagagggagcgggtggctcaggccacaggggccaaagagttatgtggcccagagtgaggaagggtcaccaggaaatcccggggtcagctcaggtcacctttactggtgccgtcaggactccgcaggaccgtgcactcctcgatgtggccaaagggctggaacaggcgtctgacgtcctcctcaccctgctgcttgcccagcatccccacaaacagctttcggtcctctggggacaaagccaggaatgacctggggaccccaagtcttcctagacccccgagagtagcctgaggaacttaggaaggcagctcaccagtctcactctgggaagcagagggagtgagaaggccctgggcttccagggttggttttcattgaggggcaggatctggggaagggatctggagaagggagctcagctcagctttccatcaggaaaacctgggtcctggggaaacccagagaggctcagggctgctcttgtggggagtaatgcagtcttgatatctctggctgggtagagccctatatgcattgttttacatgtttgacctttctgttcttagaggttgggaaacgctgttttggaccatttctgtactattaaggaagcgggtgctcagagaaagcctttctattcagactgggtccagagaagagaagtacatccttgctggtcagcctgatagtgctggctagaatcaatgccccttcctgctaatatcaaggagggttctggatttagaaacagcacagaaaacagtcctgtcatcctactgcctcatctttaggcactgagcactggcatgatgaatccttaccctctgcaccacatccaacctggatgcccctcccaaaggcctacagagagcaggaccttggtttcctgagcctccaacattagcatttttcctactacagttgctgaacccctgacccctttccttaactcccacctccaccaccctgtcccttcagcaagcttctagtgccctgtctgtatccttccctctgattcccctgtcctcttgccctgatgcctcccaaaatgttcatgctatgagagaacaagttctgcctatagacctggattgccaccagagaaccagtctgattcctccctgtgtccaccctttctatgggagtggcagaaatgcaggaaaggggctgcaagctgggcctgtgtccctcgaagaaagctggagagctggggctggaaactagggttttgccgcacatccagcaagttaggcctcaggaacactctgggagcgtggggtagaggggtccagcctgctgttaaagtctggggctcttctctgcaccaaggtaaatctctgaatttgggatggggcttgaccatgtaggggacaatacaagttgggagagaaggagtgggtaggaaactggtttcaggcttcatcttcaagaccttggagtgcaggaaaacccatcctaaatggttctactccttgaccagcttggctaggcagatgggggtccttggattctgagtgcagggaaaacaaggctagtggggggtcatagactgaagcctgggtgacagcgaaggaagaacagactgttcaaaactgaacgaagttagcaggggagaaatctccaacaagactatgtgtgtgtccatatgtcacccgggtggtgtggggtttggcctaggctgccttggggatcctgaagtgtctgtctgtctgacgatgctatgtctgtgtggagggcaggggctgcagttcataaggggcaggcaaaatgtgttttagcaaaattctgccgtctgtccagagaggtaccatccgatgatccttggagaggggatggataatggacttgtggctggaattctgatggaggaaagaaggtctcaccagtgaccttctgtggtgagagtacaacctggtgggtgtactttgcttctgggggtgtcagccacagaatagtgcccttggaacagatcactggtttcccaaccttttgaaaaatcagtggaatacattgttctaacataaatattaggatgaagctcaaaatgtaagagaaaaatagaactgctgtgactgaagccagaaaaggaggggtggagttcatcttgcttgatcctcccctaatactccctagaggggctccaaggaaagccctttgaaattactgacctagaagatagagaacagagttccagctgttgtttgaggggggatctgagatcatcctgttcaggagcctgagaagacaggaaaggtctttcatgagtctctcaaccaatctgatggctttgccttgacattggagaatgggctcatttggccagagaatcaaaccccgaaagaccatgccattgttctaagttattctgggctgcagaaggcctgggagaggctggagaagagtctagggcctccatagtcccaaggggggcttcacaatgccctaatttgtagtggagctgtgtcattgggcagggtctgaaaaatggtgatggcaccccaataagatatcataccacatggaccagaatccaggtagccttgtgtaggaagagagacatcacaggctgagatagagcccataagacagaaaagaggtttgtactgacagtggtgatctgatccttcatctgctctgcctcttgttgctttttctgctgatggtgaaattttccgatcctcttttccagtgagaatctcacaagttaagaattttcagcagggcgcagtggctcacgcctataatcccagtgctttgggaggccaaggtgggctgatcacttgaggtcgggggtttgagaccagcctggccaacatggtaaaaccccatctctactaaaaatataaaaatagccaggcgtggtggcacatgcctataatcccagctattcaggagactgaggtgggaaaatggcttggacctaggaggcggaggttacagtgagccgagattgtaccactgcactccagcctgggcgacagagtgagactccaactaaaaaaatttttttttccatttccctgtcagggcactgaccctatggatctggactactgggatgtacagagtttggaatggaaatgagtatctaccatggggtgggctctaggctcctgtttcccaggtatcaccttaaatcctggtatcctctttgccactttacagggaccttgattgtgtttgacaggaggataagctggatcacagtggtcatgagcctcaggtgacccagaaatggtgggataagtttcttaagagacccggccaaagagaagtacatgctggacccctaacagtagccccgcaaacccacagatctgaacattctgatggctgatcattgattgcctccaaagagagatgatgatgggatgtagcccagataattcagtttcctctagatcaaattctatcatttggataaaaagcggacgctacaagaggcaagtcagaaatgtctgaataaaagtatcccatgagtggtgggtagtatcctagaaagatgggaatatcaaacatggacgctcaaccttcctggagtggaaagtattagaaggcagcatcagcgcagagttgagacatagttggaatgccatatggttgaatggtataactgcattttcctgttggcaaccgatgtatacttcttaatcttctatcaaatgcttttttttttttttttgacactgagtcttgctctgtcacccaagctggagagcaatggcacgatctcggctcactgcaatctcctcctcccaggttcaagtgattctcctgcctcagcctcctgagtagctggattataggtgcacgccaccatgcccagctaatttttgtattttttagtagagacagggtttcaccgtgttggccatgctggtctcaaactcctgacctcaggtgatccgcccgcccaggcctcccacagtgcttgggatttcatgtgtgagccaccacacccagtctcaaatgctttttgagtccaaaacaagtggcttaggctcccagaggcccatctccatgaagctgccttgtgcagctggtcatataggtcagggattcgaatgcagcaaatgatggggttgacatcccagtaatcatagcagaatcaatccagactacttcttcagaaagggcaccaggatgctgttcaaggaaggagcgtctgcctcatgttgctccaaagaaattcctaagttgttcaagtttcttgttttctaggccactcacaccaaatcacctccatgttggtgaaatgtaatgattgtagggacagtgtaaggaaaggtccagccttcgggtaccaactaccagacacatcctaaaaatactggtccatttttcaatgtaaatgccaacccagaaagtcttgctggtggcagtaattgtattacagcaaagcaactctctcctgatactcttagtgacgactgcagcataagaagccacggggaaagtgacagaaggaagtagccaggacgagaagagtctcctggccagatgtgacaggcatcaggagggacttaaattccacacacaaaaaaactgttagaacaaataacccaattcagcaaagttgcaagaaataaaattgacacacaaaaaatcagttgtgtttctacacactagcaatgaacaatctgaaaatgaaatgaagtgaaagcaaaagccagcacggtggctcacgcctataatcccagcactttgggaggccaacgtgggtggatcacatgaggtcaggagttcaagaccaggctggccaacatagtgaaaccctgtctctactaaaaatgcaaaaattagccaggcatggtggcatgtgtctgtagtcccagctactcgcaaggctgaggcaggagaatctcttgaacctgggaggtggaggttgcagtgagctgagattgtgccgctgcactcctgcctgggagacagagtgagactgtgtctcaaaaaaaaaaaaaaaaagagatgaaagcaaacaattctatttgcaatagcatcgaaaagaataaaacacttggaggccgggcatggtggctcacgcctgtaaacccagcactttgggaggccgaggtgggtggatcacctgaggtcaggagtttgagaccagcttggccaacagggcaaaatcctgtctccactaaaaatacaaaaattagccgtgtgtaggtggcaagcacctgtaatcccagctacttggggggctgaggcaggagaatcgcttgaacctgggaggtggaggtttgcagtgagccgagattgagccactgcactccagcctgggtgacagagtaagactgtttcaaaatacataaataaataataagataaaataaaatacttgggaataaacttaacccaggaggtgaaagactcatacactgaaaactacaaaatgttgctaaaagaaattaagaggccaggcgtggtggctcacgcttgtaatcccagcactttgggaggccgaggcgggcagatcatgaggtcaggagtttgagaccagcctggccaacatagtgaaaccccatctctactaaaaatacaaagaaattagctgggcgtggtggtgggtgcctgtaatcccagctactcaggaggctgaggcagaattgcttgaacccaggatgcagaggttgcagtgagccgagatcacgccactgcactccagcctgggtgatagtgcaagactctgtctcaaaaaaaaaaaaaaaaaaattaagaagacacaaataaatgaaaagacaatctgtgttcatggattcgaagacttaatattgctaagatgtcaatactactccaagtgatctacagatttaatgtaatctctataaactcccaatggcattttttgcagaaatagaaaaatccatcctaaaattcatatggaatctcaagggactccaaatacccagcaatcttgaagaagaagaagaactccctgttttcaaaacatattacacagctatagtaatcggcactatggtactggcataaagataaatatatagaccaatggaatagaacagaaatcccagaaataaactctcttacatatggtcaaatgattttcaacaagggaggcaaggtcattcaataaggaaaggacagtcttttcaacaaatggggttgggaaaaatggatatctacaaaagaatgaagttagactcttacctttcaccatatacacaagattaactgaaaatggatgagtcctaaatgtaagagctaaaacaatagatgtcttagaaaactgaggggaaaaagatttcctgacaggatttggcaatgatttcttggatatgacaccaaaagcacaggcaacaaaagtaaaaataaataaattggactgactacatcaaaattaaaaactttaacaaggatctattggagggcaaaaataaaaaactagaaaacttctgtccatcaaaagacacaactcacagaatgaaaaagcaacctctggaatgggagaacacatttgcaaacaatatatcaagataagaggttaacatccagaatatataaagaactcgtacaactaaatggtaacaacaacaataccaacaacagaaaacaccaaaccttctatttaataatgggcaaaggatttgtatagatgtttctgcaaagaagaaatacaaatgggcaacaagcataagaaaagatgctcaaaatgactaattgttaaggaaatgcaaatcaaaactacaatgagatatcacccacctcacaccgattaggatgactgctatcaaagaaacagaaaatcacagcgttggcgaggatgtggagaaattggaactcttgcacactgttgataggaatgtaaaatagtgtcgctgctacagaaagcagtatggcagttcttcaaaaaattaaaaatagaattaccatatgatctagcaataccttttctgggaatatatccaaaaacattgaaagcagggtcttttcaaaaattaatctataattttatttcaattgaccaataataattttatatatttatggggtacaatgtgatgctttgatatatgtagacattgtgaaatgattaaatggagctaattaacatattcttcaccttgcctacttatcacttttttatggtgaagatgattgaactctattagcaattttgaagtgcatattgcattattattaactacagtctccatgctatgcaatagatcactaaaacttcatccttctgtttaactacaactttgtatcctttgactaacatctcccctttctccatactgtaacccccctgccgcccctaacttctgccaaccaccatcctactctctgcttctatgagctccacttttttaggttccacacgtaagtgagataatgcaatgtttgtctttctgtgcctgggaaaacaagatcttgaagaaatcttttgtacacccatattcataacaacattagttacaatagccaaaaggttgaaggtacccaaatatccaacagatgaacggataaacaaaatgtggtatatacaaacaaagaactattattctgtcttaaaaaggaaggaaattctgacacatcctacaacgtgaatgaaacttgaagataggctaagtgaaataagccagtcacaaaaggacaaatactgtatgattccacttacataaggtatctagagtagtcaaactcacagaaataaatagaatgatggttgccatgctgacggaaattgggaaatggagaatcatttaatggatacagagttactgtttctgcaagaagaaaaagttctgaggattggttatacaatgtgaatgtacttagctctagtaactgtacccctaaaagtgttatgacaatcagctttgggtgatctgctctgagccaagcctaaggaaagcacctctcattacctttgtgggtagaatgcatttcaggaagtgaagagttaatgtgaggaaagggtcaagtagtacaggtgaaatctatccaatcttagttggaaaatactttttagaattaaattcatctaaggaccaataacaggtatgactgtcaactgactgtgacagaacagttgttgctaaggtctatttctgatttaggccacggaatatgtcccagtactatgaaattctgaaaattctacctcaaaattcaattttaactcaaagattagttgttaaacactgaataaagtggaatcctagaaagaacttggaaaagatggctctgctagtgagatagtcatatatgcattatgtttatactcaaaatccaggctgacatctaatcaaacccttgcaaattcaggcagaaattacttacgcaattataggatagtgataggagggttaattggataacagataattggcttttgagttgaaccaaattgcaagactgaaaaacgagatgcctcaaaatatattttaaaatcctcagagaatgttttaagtttgaacgttaaaagaaaataactgaagtggaaagagtgcatggattgattacctaacctatttctgtaccttaggcatcttggatacatgaatatttgctgagtaaaggacacagccaagttgagaagtggaacaagcagagcaatcaccattgtgatttatgtattgattctatgctatgaaatttgaaagaggaaagaatatacaattcaataatttttaatattttgctttaggactaaaaactacttttcctataagatcggtacttatagtttaacttattggtgtttccaaagtagagaaaatataagtgaggaaaaatcaactacagtccctatgccgaacagcaaataaaacagacttatttagttaccattgtctgagggatttggggatccttatttctgacctcatataatttgtggttaacattttaaaaatacgtgaacctaggccaggcacagtggatcatgcctgtaatcccagtactttgggaggctgaggccggtaaatcacttgaggtcaggagttcaagaccagcctgggcaacatggtgaaaccccatttctactaaaaatgcaaaaattggcagggtgcggtagcaggcgcctctagttccagctactcgggagggtgaggcaggagaatctcttgaacccaggaagtggagttgtaccttgcagtgagccgagttgtaccttgcagtgagccgagatcatgccaccgcactccagcctgggcaacagagcgagactccatttcaaaaacaaaacaaaacaacacaacaacaacaaaaatacatgaaccttgaatttttacccatacaaacattttaatgttcatgttcaaatgcacacaaatgctgagggaaaaggttttttgttttttctttttttttttttttgaaatggaatctcgctctgttgttcaggctggagtgcagtggcatgatctcggctcactgcaacctccgcctcctgggttcaagtgattctcctgccttagcctcccaagtagctgggattacaggcacacaccaccaagcccggctaatttttttgtattttagtagagacagggtttcactgtgttgcccaggctggtcttgaactcctgagctcagccaatccacccgcctcggcctcccaaaatgctaggattacaggcgtgagccaccacgcccagtcctgaggaaaaggtttttgacactatgtgtatttaatgtatgttaggagatagtttcattttagaaagttagatgcattttcctttaatagtgtactgctcaatgtgtagctgccacaggatgtaaaatataggcctggagtgtggagtataggaacagcgtggaacttagctacagaatttatgcaaactcactggaatacattaaaaggctgctataatatatccacaaagacccagatgcacctctggtactctgagaaaagtgttgccaaggctgcgggagatggccatgacagaaaaggaccttgacatcttccatcaggcagatcctggtgtattgctaatattaattgtattgcaggcatcgaattaacaagtgttaccaataactattaaaagtaatacaacaggggccgggcacggtggttcttgcctgtaatcccaacgttttgggaaggcaacgtgggaggatcatttgaagccaagagtttgagaccagccagggcaacaaagtgagactctgtccctacaaaaaataaaaatacaaaaattagctgggcatagtggcatgcacctgtagtcctagctactcagggggctgaggcagggggatcacttgagcccaggagttcaaggctgcagtgagctatgatggtgccactgcattctagcctgggcaacagagtgaaacactgtctctaaaaaaaaaaaaaaaagtaaataaacagacaaatcagtaaataaataaaaatcataaaatatacaatatgtatgttggttatttcaaccacaaacctcatgtttattgattaaaagtaagactactagtacactgttacatcaaaagtcaagtgacagaagacaaagtagctatttttgtaaaaaagctaggttgggcgtggtggctcacacctgtaatcccagcactttgggaggccgaggcagacagatcatttgtggtcagcagttcaagaccagcctggccaacatggcgaaacctcgtctctactaaaaatacaaaaattagctgggcgtgctagtgggcacctgttatcacagctactcaggaggctgaggcaggagaattgcttgaacccaggaggcagaggttgcgttgagtggagatggcgccactgtactccagcctgggcgacagagtgaaactccatctcaaaaagaaaaaaaaaaaaactcatgtgtgcacaatgtaatcctgctttatggcagatggaaaaagaagcaattatgataggtttggtaggctctcacagtgctggtctatttttaaaaattgaattagttgccaacatttaatacagctaaaatgattttttttttttaagacagggtctcattcattcacctaggctggagtgcagtagcgccatcttagctcactgcagcctcgaactcctgggctcaagtgatcctcctgcctcagcctcccgagtagctgggtagctgggactaaagatgtatgccaccacacccagctaatttttgcatattttttgcagagacagggcttcaccatgttgcccaggctggtctcaaacttgtgagctcaagtcatcctcccgccttggcctcctaaagtgctgggattacaggcaccagcccacatgcccagctgtaaattattttattaaaacatgggagtctcatccatttaaggttacctacctgggctcctgtagtatttgagctgatgatccctacttgatgggaagaaaaatcatgcataatcccttccagaagaaactggaaggttttggaagaatatgttggccttgatatcccttagattgttttcattgacatcagtactcttatcggataaagaaaccattattaaccaatggtaaactaagggatttaatttcaggaataattttagaagacacaggcttactggcgtaaatatatctggtcaggtgtgtgtgaccattgactctgacagtttatagaatgtttgaggtcacagatataagacttaaatgggacacgctgttccacgttgttgccaaatgttacattttaaaagcaaaatccaataccattttaaaaagttgattttttttttttttttttttgagacagagtctcactctgtcacccaggctggagtgcagtggtgcgatcttggctcactgcaagctccgcctgctgggttcacgccgttctcccgtctcagcctcctgagtagatgggactacatgcgcccgccaccacacctggctaattattgtatttttagtagagatggggtttcaccgtgttaaccaagatggtcttgatctcctgacctcgtgatccgcccgcctcggcctcccaaagtgctgggattacaggcgtgagccactgctcccagccaaaaagttgactttctaaagcattaggttgtgttaaaattcagcagagggttgaactcactttagaagagatatatgatagcactgaagaaaatacattttgattagtaatgattatctaacacagatctgttagtattaaaatacttataaattgtaaaggcccaactgttctgcaagactggatacataggccttttctctcctgaatatatagtagggagcagggaggaattgagagatctggtcatccaaacctgcaagaaggattattcatggatgcatttggagtgtatgcttcttgagagccaccacttgtccagaaatatctgtgtaacacaactgctaaattatgagttctgctgccaggcaatactctttttcagctagatttgcttttcctgctcttttaaacaggtgtataggtggaaatgccatatgtacagaattttttaatgatgtgacacctgcaaagtttatacaaaaatgtggaaagaaaattctacaactcaagctgatgtcattgcttagagcccagaccaccagaacacatcaaccaggccaagcaaaagcactatcagcatggaggccccctttgtgcggctgcccaaacactgacaagatgtagtggactccatacagcaggagtgccctagcattgtggacttagttcctgagcaagactccaaattgcaccacgttcttctgagctctggggcctgcggacatgctcttcctctgcccaacatgcttgctccctctctcctcttttctctgactacttcctattcatccttgaggtctcagcttaaatattactcctctgggaacccactttgatcttccagactgggttaggtgccccttgtttgtgtccccacaattcccctggacttccccttgaaagcagtgatcacactgaattgtgttcccttgtttacttgtccatatcctctcatagcatccgtgcttcatgaggccaggtaccaggtctgctttgctcacatctgtattcctgctgtggagtaagttgctcagaagatgttggttgtgtggttgaacctgtctgcttcacagctcactcacatactcttagttggcttctcagctgtgggactggctcatggttgtgggcagggcttagtagttggccaacaatggccttgatgcataaaagagtttcccaagaggcagaaattcttgggttacatgaacatgaagttttgcatgcagcctggaacatctcaaaaacctgactggaaagaataaaaagggaaaggagaatgtgtgtgtggatggaggaggaaacttggaaatatctctccaagacaaggtgaaggtgataacattttgaccagaaatcaagaatcagagaccagaggtcagagaatctaaaaggataatggaagtatttcttggaggaacgaacttcacagtggaaccacaaagtcaccagaactctgtgtgtgggttctcagactgagcatgaagtctgagaggggtacagaattagtaggactcaatacatgtttatatcaattgggttccattctgttcctgaactcgggcagcttctttcagctagcaaagccatggctgatcttgggttagacaggaagagagtcttacccaagataaagagtcagcagacatcagggagggctataggctgatacactggaaggatctaagatgcaagggtgagaaaaacaccaagaactgacaccagaatccagccttgcctttacagcttggaagctggccagaacccagctggttagaagaaagcacaggctctctaaccgtcctatgtggttttgtttttgtttttgtttttgttttgatacagagtcatgctctgttgcccaggctggagtgcaatggcgtgatctcggctcactacaacctccgcctcccaggtttaagcgattctcctgcctcagcctccctgcctcagcctccgagtagctgggattacaggcatccactaccacacccggctaatttatctatttgtagtagagacgaggtttcaccatgttgcccaggctggtctcgaactcttggcctcaaatgatccacccacctcagcctcccaaagtgctgggattataggtatgagccaccgtgctcagcccacctcctgttcttaaggagctctgttttttctctaccaggaaacagtgtagctatcagagctttccatggtcctcagcatagaggacttactatggcccataaagtctgtcgtaccagccttatcttttaccatgagcagctaggcaattacaatgaaggaatggcctcaatccgaaacggactgtgttttctgatatcagaaggatatggagaaggagaataacccccacctgattcttaaaaacaacaacaacaacgaaaccctgaaagttccatgtggcaaaacaggaatgatctctctccaagggtaagtggcaagaaccccctttctctatcactggcatctgtttaggcccttcttgcctcttctgggcctgggctccccagaaccccagccctgctcagtctgagcagggaaggctgagctatttctggggctcagcaactctgagccccacctgtccccttgacccagggaggctctcatactaaatgggtaggacagactccaggtgtgggcccaccctcccttacacgggttgcagcctgaggttggtcagacagggaagttacctcctcggccctcactggcagctggcttcacttggatcggacgattcatctgaaagacatcggaccaacacacccattcagcgtgactgcctggtcctggagcccccagcttctcgaaccctggactcctcaggatctgagccctagcccctttgaactctgcactctaccacttccaaactgggattacagattttctccaagattccttccttaaacccaggaatttagaaggtgctgaaactggcagggatgggtgacaggaacttagtggcaagcacaaggtggaatgaagcggctaaagagacttttctgcctggggctctgggcaggggctatgtgaggcctgtccctttggcttctggacttacttaaaggctttgcatgagaggattgggaaggagggtagaattgatactgcagatttgtgttttatgtctaaaatggagaatatcacgctatgtgtcatttagatgagagtctgggaatcagactcagtgctatctgccctcaactctagtcatttaatggttgtatgactttaagtaagccaccttttctcagattcaatttttctttttctcctgtgtagctgaaattacaggcacgtgccaccaggcccggctgatttttgtatttttagtagagacagggtttctccatgttggctaagttattcttgaactcctgacctcaaatgattcacccgcctcagcctcccaaagtgctgggattacaggcgtgagccactgcgcccggccagattcaatttttcaaatgaggaaaacatttcccaagctgctgtatcactagagtctccacgctcacctgctccatcccctccctagggtccccttccctgaggatgctggagttttccaaggtgccgttctcagccctttttgtctggctcttcctacttttcttggatagtctcatccacactcagcctcagctcctctccacacagggatgacttagagctctgtgtctccagcctgcattctcctctgagcttcagagccatgttaccagctgcctgctggacatccccactagaaagtcccacgggcgccttcactcaacacacccaaacgagagctcatttgtttttttttttttttgccccaacctgatcctcccagtcacccaagctataagcctggaaagcagcttgacttctccttccatcccttccccgctcccaccaacttcatcttttaattcaggggttcctgaggaagtgtagataaaaatcacccaggaaccagatgaggctcttaagttggggtattgcataatttgaaaacgctcctaggtgatttcaatatatcgcccccacatccccatcccccaaccaccctgagtgaattcatgattgaatccccatctcaccttcctctcatgggtgttgtggggatcacatgaggtaatggggacgcaaaaggtctttgtaaactgccaagagctgggtgcgtgggaggtgaggaattattgttggggggcaggcagctgagtgccaggagggaaaaacagcggccttcccgttcatggaggaaggggtactgatgcccatctggcctgagaaggtgatgatctgaccccctcccctcaagaaatgctctgcttctgcaccaatcaggggccactccatcccttaccaatttgctcgttgccgagacaacaggcagcttcctgttaccatagccacaagtgctacccagtaaccatggtaacgccctggcagtcacagttgagcaatttcctttggatcaaatttgggggtgggaggggcagggagggcttactaaaaaaaaaaaaaaaaaaggaaaagagaacaggccaagtctgaaccagcgcaactcccctcccacccagggctctgacacacccacccgctggtggtggagcacctgcagtgtaccaggctgtgggtgggggcggagacaccaacaggactcaggttgcagtctagaggggatgacagatcaatccaagcagatcagggcgagcttgacaggtctggactggcctggaccagggaccaggaggacaggacccgtccctgggcatggccacctgtgattgtggaggaaagaccaagagacagagccatggagagcagagacacagggagagatgaagaaacactggcagacagaaatgatgtgagagaaagacagttctagaaaggggcaaggaaagagagttactggtggagaggggaaggaaatgaggagaggaagggtaaggaagcgggtgcaggagaggcagggaggagcctggtagggaagaaggccaaaagagtagaagcctggggtggggggcagtgagggtgagcaagaccatcattattttattagttcttaaatagatcctgagaatttctctctggagcctagagtgacgagcacacgtgacagcagcagtttccatggcagctgcctccctggctgggtttcctgggagatggtgctctgggggacgccaccttctctcctcccacccacttccccacccttcaacagagagtgggcatcgggtggtacatacatgttcccccctggacctgacctaggcctcccaccacccaggcatgctgccagcatttcctgaactctgtgatgagccccaggcagcctttcgtgggagacagtgatgatctgtatggggatcctctcttcataggctcgcagaggggaagataatgttaccatttcctgagagcccactctgtgccaggcccttcctgggacactttacatacattgtctctaaatccttccaaccactcttcaagggaatacaagtgtccccatatcatagatgagaaagctgaggctgagggaggtgaaatcacttgtctaagatcccatggtgggtaagtggttgagctgggatttacccccagatctgtctgaggctgaagcccatgatttttgcactggagtgctgctcaaatccattcttaaggcatgaacacaaatagtgaggcacagagggaccagggcctcgggggagtgcaaggtcaagagctgtggaagaggcagactccagctgaagaggttgactgaggaaagctgcatagaagaggcaatgtttgacctgagccttgcaggactggggtcattggccatgtagagataataggagaggtaggagtggtggctgagcacgctgaatggctagggtacggacagggagctgcaatggctagggtacggacagggagctgcaagcctgaaggagcaaagtttctagtgagcacttggcatgggagtagccatggtagagcaaattgcttcctagcagatagatgtggatttcaatcctggctctaccacttgcttctctaaggtctctgagcctcaatatccacactagtgaagagggaatcatgatcttaacttgcagcgttgtgatgaaaatgacaactgctagatcttagtagatacctcagatataaaaagttattgtttttttttgtttgtttgttttttgagtcagagttttgctcttgttgcccaggctggagtgcaatggcgtaatctcgcctcaccgaaacctctgcctcccaattcaagcaagtctcctgcctcagcctcccgagtagctgggattacaggcatgcgccaccatgcccggctaattttgtatttttagtaaagacggggtttctccatgttggtcaggttggtcttgaactcccgacctcaggtgatctgcctgcctcggcctcccaaagtgctgggattacaggtgtgagccaccgcacctggccggtttttgttgttgttattgttgttaaggatatgaaactgaaaggtaggcaagggccagattagggaaggctgtgaaaaccgcatcaaggaattttgacttttgactttgttgtatttcaaaggcaatgaggatccaggggagggaaggatttttaaatgtttttttttaaacatttttatttatttatttattttggagactgagtctcactctatcacccaggttggagtgcagtggcgcgatctcagctcactgcaatctccgcctcccaggttcaagcaattctcctgcctctgcctcctgagtagctgggattacagacacccaccaccatgcccagctaatttttgtatttttagtagagacggtttcaccatgttggccagactggtctcaaactcctgacctgtggtcttactctgctacccaggctggagtacagtggcgccatcatagctcactgcaaactccaaatcttgggctaagcgattattctacttcagcctctcaaatagctaggaatacaggtacatgccaccatgcccagctaatttttaaattttttgtagagactgggtctcactatgttgcccaggatggtctcaaacttctgggctcaagcgatccttggacttcatcctttcaaagtgctgggattacaggtgtgagccgctatgcccagacaggaaagggttttaagtagaggaatcatctagtcagttttgtcttatgaaggatcccataagctgtcactatgtggagaaaggattggaaaaggagtgattagaggcaagaagatcagtggcacaggtgagaggtgaatgtgacctggatagaaagaaatgaacagatttaacagatgtgtaggaagaattaactgggctatagttctattggatatgtggacccgggaagaggagggcatattggctgagcctcaggttcatcgcttgggagttggggaaggtgggagtttgggagtttgggggtacaaggaagtccccaggggaggaacccaagagagtaagaacagagttggggagagcagggctctgagccttcagtccccacagagcagtggtgatggaggacacctgggatttaggcatgttatgtgtggctggaggagaaagagagctgcccccatgagcttcctgggcaacctattatatatatcttgttcctgccatgggcagaggagggacatggcagtgggataatcaggacgtaatcaggagtcccccttgaggaaaagaggacattgcctcccaggccaaaaacttgtcctgggacttcaggtgagctcttgccctggctgagcacctgttcccttaagaatttcccaggtggagtccaggcccatgtctgcttcagagcccagccctggaggggaattcaagggatagaatgtcagagagaacaacctattccaggcaatggagtgggaaaggtcagaggccgcacagacacgcacagggccctggaccttctgccccagtgagcagaagggagagcaaaaccctacctaactctctgccctgatttgtctaaaattcctccctttgggctcagcattgcccttttcagattcttctgccctgatgccaactattcttttcactgagcactcacaccctcagcactccccattccatgggaagagtttatcagaaccttcttgaggaagggaacactggtaggtctgggaaaggtgtcaggaggtgcagggcagagtgggacagaaaaaaaccaaactttctaatttttagtactttgttttacctcacccccctcctctaattcaacccactgtcaagtcccattggttctagaatctatatggatatcctaaacagctctgaaatctaacctcttatctcctttcctggcctatctccagctctaggccagcatcaccattcatccacactcaagcaacactgcactaaagggtcatccagcctgcagtgttgcttcctttccaacccaaccttcttcacaccatagccagagtaatcttttttttttttttttgagacagcgtcgacctccagggctcaagcaaccctcccacctcagcctcccaagtagctgggactacaggggcacaccaccacacctggctaatttttaaaaaacttttgtagagacggggtctcactatgttgtccaggctggtctcaaacttctgggctcagcgatcctccagtctcagcctcccaaagtgctgggattacaggcatgagccactatgtctggcccagagtaatcttttgaacctagtctcttactcttctctgcttaaaatccacctctgttcccccattgcaagcctcctgttaaagcccaagattctaagactagctgtcaaaacttgtgagtctttcttccactgctgcccaacatgcacgattctctctactcatgtggagccttagctatctttgctagacaccttccctgccagtgttcacactgtccccaaattttcttgtcttttaggtttctagatcctcaaatatgataaaatatgatcatgattcagctcagataacatctctgcaaagcatctactccctccccatttctttttattcttttctttattcctttatttatttatttatttttattttgtatttttgtatttttagtagagacggggtttcaccatgttggccaggctggtctcaaactcctgacctcaagtgatccgcccgcctcagcctcccaaagcgctgggattacaagtgtgaaccaccgcacccggccttttcctttacggtttgactctgggactccctccccaattctggtctctcttttacttgcccagatgtatgcctgagtgagatgcaatgaggctcaccttttttctttttttttttttttgagacagagtctcgctctgtcacccaggctggagtgcagcgatgcgatcttggctcactgcaagctccgcctcccaggttcacgcctttctcctgcctcagcctcccgagtagctgggactacaggcgctcgccatcacgccctgctaattttttgtatttttagtagagacggggtttcactgtgttagccaggatggtctcaatctcctgacctcgtgatccgcccgcctcagcctcccaaagtgctgggattacaggcgtgagccactgcacccggccaatgagactcatttttaagaagcatcttgagggcaaagactcagactcattcatgaagtggttgctagcacatacagtgcctttctgtaaattataaaaaggcactccccaaccctgggatgaatgagaaaaaatgtgccctttcctctgggctgacaaagccttgaaataatgtgcatgacttagtcaatagagcatggctggatttttgcccccatctgccctctctacccaagctgttttgtgcagggcacaacttgcaaaagcaaatgtactcccctactcagtaacatctgccttcttcacagcgtttgaagggatggcttcccaaagaaagggaagtcaggaacagggagataaacaaatagggaggcaccttatgcatctcgtaagtggggctgaggctaggcctcaccctcttcaggtggattctggagcataaagtgaggctaaaagaaggaattctggcttcatcaggaagaggctgcaggaggtgggagccaggtgggacagaccaaccaaggtttgaaggagttctcgaatagggaggcaagctttcataggggacagaaattggcaggggacaaatggagaggagccaagcaaaagaaggtcttagtcaatcagaatccatgaaattcttggccaggagtggtggctcacgcctgtaatcctagcactttgagaggctgaagcgggcagatcacttgaagtcaggagttcaaaaccagcctgaccaacatggtgaaaccctgtctctactaaaaatacaaaaaaattagcttggcgcggtgatgggtgcctgtaatcccagctacttgggaggctgaggcaggagaatcacttgaaccctggaggtggaggttgcagtgagctgagatggcaccactgcactccagcctgggtgacagaatgaggctgtgtctcaaaaaaacacaaaaaacaaaaaacaaaccatgaaattccccctagggtttcagacttttctctctgggggctgacctagccttttctggtcccatggtgacagtcctgcctgatgccagcaggaattcagattaaagtcttgtccctgcttctccagcaggtggcagctgtgctcaggacccaatggcagcagagagctgggcactcctcctccatgctggtgggcctaaggccaggcgactaaagttgctgctgtccctggcaggcccagaggaaagattgatggcacaggcattgctggggctggccaacacagccattgattttcatttaggagaataattaaatattaattttcactttgttaagctggagagggtgaataaagccaatcctgacagtatcagaggaagccaggccatgttggagacctgcagatgaaacagtgagagggggaagatgtccccagtcaccattctctctagaacctaagacccctgtctgctacctggttgtctcaggtcacagtacagtggttaagtgaatgagttctagggccagattagctgggcccaaagtccagatcttcccattattaactatatgaccttgggcaagtcacttgattcttatgacttagttttctcacctgtaaaatgggaatgccaataacaataccttatttaggcctggtgcggtggctcatgcctgtaatcccagcattttgggaagccaaggtgggtggatcacttgaggccagaagttcaagactagcctggccaacatggtgaaacctcatctctactaaaattacaaaaattagttgggcagagccctgtgtcttgtggaggagagatttttttcctcccaaagtttatcttaatttttttgggggggacctcccatttcctttcagggtaaagcctggcattcaaagtttcatcttcaactgctgccctctgtagatcttccctccagcttccctccatgctcacgtgggcctcccccacagtgccagccgcatttcacacccacctgttccttctgtgtctgcacctttaccatgctgtttcccacatggaatgttacagcttgtctcattgactctcagttctagaagcagaagtcatttgctcccatgattagatgaatgatgagttctactcctactcctactaatgctgctgttactattactgttactatcactactaccaccagctaactcatatcgagtgcttattttctgccaagaacagcattgagtactttagttcacttaatgacttagctcatttaaccacgacaacaaccctatgagtttaactttacaggtgaggaaacttaggcttagcagtaaagacttgcccaaagtcacaaagctagtgagtggtgggcctggatccacacccaggtctctctgactcaggagcttgcatacagaggaccagtgatggtgacaaattggtgttacttggcacttagtccccaaaagtgaggctaaaggtgcttcagttactgtgcttggttctaggagctgtcaccccattaacagcttgattagctcttggcgaagcttgctccattgcttggtagctccaattcagagaagtgacttctttatactgagctgaaatcagtgcctatttcttattatattaactgatccgaatcttgccttctgggatcactcatagaaaaccaaacccctcttctagaatctgaaggtagttaccccaaccccaacagtagtacttattgagatcttactctgtgccaggcacttgctaagcctcaagtaatcctcactacagccaagcgagctaggtgttagtataacccactcctcatatctaaagagactgaagctcaggagtccaagtaacgtgcccagagacacagaactgataaatggcagagctgggattcaaatccaggtctgtgagactcaaaacccagtgtttttttttttttttttttttttgagactgagtctcactttgttgcccaagctggagtgcagtggcatgatcttggctcactgcaacctctgcctcccaggttcaagtgattctcttgcctcagccttccaagtagctgggactacaggcatctgccaccatgtctagctaatttttgtatttttagtagagacagggtttcaccatgttggccaggctggtctcgaactcctgacctcaggtgatctgcccgccttgtcctcccaaagtgctaggattacaggcgtgagccaccgcactcggcctcaaaaaccagtatttttaattattagcttatgatgcctccctattaaagtccctctaagccctatctcctccagttaaatcatcccaactcttccaaactattattccaaatatatcttgtgtctttacttcatcctcgtctctttcttgtagacaaacgactctcttaaatttgagaggcctagaactggacatagtcccaagtttggcctgtgaatggcatttaaacagtgctctgttctagacacaccgcttcttggacaagagaaaacaaggctgtatagtatgacttgctcttggtaaacccatgctagttactaacgatcacccctttattctgccatatggtcagtaggtcccaccttgccttttgttgactgattatccattagccaagaccagaccaggtaccattggtgcctacaagccaagctgcctgtagaatcaggtctcccctaactttagccaagtgtttgcagtgtggagggaagacaatcttagtgagtcaaggcaccaaaaataaccattacaggaaaaggactagagagaagttccagcaaggaccttaggactagagaaaatgggctaccagtccagcagaacctctaccccatgtatctgcatacatgctcacaccagtgacaagagacacccaaagccataattttaccaaggtgaataaattctagcttagccctcaacactgatgcctctcctaaaagatgggtggaacgcctggcccaaggatcttgagccccttttttgagccagaagattggatgtaacaaagaatttgttgctgttcagggtacaggaagccctctcctagaaagatgactctgcttctagttctcggtcccaacccagcccccacatgctgctttggcatgcacacagggcactgtccccagcctgaggtgattcccaccccccaacctggaggacttacccctggcagggtcttctgctcgtgcagtgcactctgggccttgagagcagagtcccgggcgcagtaggtgaggaaggcacagcctgaggaggaagaggctggctcagggggtttcctgaaacccccaactattcttcttcgaaataccccactaagttgacaaacttaaggccactctcctttaagcaaggactctgctttctgagaagccctctctgcctcccacctctggagggaggggcttcatgtgcctggggaccagtgtcccaggctctggctccctttcatttgctcctggcatcctgcccagagaacatatgtgcccacacccagtcacatgtgcatacaatcccacatctcccctccccactccagtcacaagtcctgttggggttaaacctccctaagcagctttatcatcatctttaacccagacttccccttcctttttggattcagactcatggagtctcccaggatcagcctcaattccttcccaactcagtttcggatgggaggaggcaaaagagtaaaagaaggattgggagccaaccccaggagcccccagctcttgtccatgtctccctcccctaagtttgaagctggggaatggattgatttgagacttagaagatgggattggtttaagggcttcccataggtgggagtttccagggaccccctaatcctgttcaaggatcttgatctgtcaaccctcctagggctttgaggtagggcctcttaaagagttattgtgcctcaaatctggctcctctaaaagggccagcatatatgggtcagcgaagaggtctaggttgagccaaagggtcaagtttagccctctgtttgttcagcctcaggacctgtagcctgctaggaagcactgaagcagcactctcctcctttccaacagccactgagcactcattcattcagaaaatatttattgaacacttacttattatggtggggcattttgatgaccttggagatagagtggcaacaagacacacattccctgccctcatggggattagacaaatcatgagggacccctaaacaagtccaaagggttgagtaatgtctcaaagaaggcactgagtcctcgagaacaagaacactgagtccttaacaatcaggtgatgaaaaggacagtgattatttcagacagagggaaaagcatatatgaagactgaatcaagaatttggtgtgttggggaaatggataggttagtgtggctggaggctggtgtatgggggcagagtggctagtgagatatgcaggaatcaagtcatatgtagccttgtgggcctcagttggattttgaactttttcctaagagcaatagagagccactttaaagggttttaagcagatctgtgagatgataagatctgttttcaaaaggagcattctgagtgtaggagggagaaggactgaaggaggagaaagtggatatggtgagccattaggaacttggggcagatttccacttagacctcagcagattagaaaggcaaatgggaacatttttttctggcctcttctacagggctgccccattaagatgggtttattgccggacattcattgagttaaagggaacttagagaactgagcaaaactcttatcacatcaacagggaaactgaagcccagagagtgggtcagtggcagggcaggatttggaatgtcttaactcccaagctggggttgttttcaaagcactgtggctgcctgcctcggtacccagacatcaaaaggaaaatgagtcactgtttctggggagaggatgaggaagatgttgacttggagaccctctacaatcatcttggaaggcaacacttgccttggagagttgtgatttagtttggaaataaatcaccaaacacctgattccacttacatccctgctctgtgttttgctaccaacccatatcacctgacgtccaaaccgggcaggttgcctgtctgaaaggctcaggggcccagttgctgcctaaagaagccccatgtggactagccgggatagagggtggaagaatgaagggaagaaaagacagagaagcatggtttgagagacagatgaatgaaaataacaggcagaattagagctaaatgaaaagagagaggatgagggaacagttcagagactgatagtgagaagagtgagatttaagggtattctatacacttcccttattgtacggatggcctacaaagattagctttgtatgtacatcctgaaatcaatgtctaaaaataagaaaatgagttactacagagggatggacagacaggcaggtagtgggagtgcattagaaggactctagatggtgaggtattgtcctttcatacacccattaacacaatcccagcccaaagggtggaagctgtactcctagccagatggtcctagctcttctattggcattttctcgaagtgcctacattagtgtgccaaggaaccctacgaggcctccaagttgaagaggtggcagtctgattccagctctcagtccttaggaatgtacctttagctgttacccaaggcccaccactcctctcttaggaagatcatggaggatagttggtgactctttcccagcaaaaacttgaaagcacagcatggtggtggtggtgggggaggagataagagtgttccttctcaaatcatctccccttctcctgcccatgtatgacatgtgactctggctctcttactccagccctgcctggacagacttttctgcatgtaaacaagcctcctccctctctctacaggaagaaaggggtgtggccgaacaggaccgtgtatctctctagaaagggcagggagaagatctccttctgtctcttcagcctgactcaccctgagaatgggcctggactgggaccagcctgtgaggggagggaaagaaagaggccataaagaggactggggaggagcaaagaagaggcacaggagtgaggggattagagaaggaaagaagtgtggatttagctgagagaaatccaagaagaaagggacacagggtggcaggagttcccagctgaggtcagggttctgaactgaaatcaaaagaggtagagtgcattgggattctggcgaagggcaggagagattggggctgttgttgaacatgagggggtgtctggaactgagagcctcctgggaattgaattggattttgtgttagacaggtctgggttctgaagaaggggagggtttgggtctgcggtgttttaggttggcagtctgagagtcaaaagaaggctcttgagggggatggccggactaggaggccagaggaggggtgcaagtccaagatatgcatgtgggtggttaggcctgagtgaggtgccaccagatggaggattcaggagtgtttgggctcagggtttgggaaattgagggtattcgagatctagaaggtggaataagttttcaaattccagaattttaggtctgatgggagaggtggtggaaaggtccaattgaaaggcagggactgctgggatgtgagaggtggaggccaggaatttggaggttagagtggagaacatgttaggggaccacagtgataatcagagggaggatgtcagagagaaaattctgtgatctgggaagggggctgggctgaggtggggctgatattggactggtgttggactggctctcggcagggctagggctggggctgggctggggtcgggccacactctaatcggattggggctgggctgggctgggctgaccccgcgcacctttgtggaggccggtgagccggtccttcagcaccgtcagctcgtagatgcggccgaactcctcgaacagcggcttgaggtcctgctcgtccaagccccgcgggatctgccccacgaagagcttgatggcgtcgtggtccttcatgggtacggcgggaccggggtttagcccgctcatgccgacgccgctgtccgcggtgctgaaacccaggcgcgggccggggccagcgggctgcgctgaccctcccggcgccgcggccatgtccccgccctgtcagccctcccgccggtcccactggtcccgcctgtcccgccgtcccctccctggaccggtggcgagggccagggggagggggcggagcccgggcggagagggcggggggctgcccagggggcggggtccgggtggaggggcgtagagggggtggggcgggcaggaaaggggcggggccggggcggggcgggcccgggccgaggtggcggctgaacgctggggtctggcttgaggtccccgtgcggctctctctgggctcccgcccgagctctcccagagccgagccccgagccccagcccccgtgcttggtgacgtcaggcagctggccgccgagtctacgcaaatgatttgcataatgaggaagcagccgccaatcagagtgggagttgactgggctcgccgggggcggggggggcggctgggctcacgcgctcctgctcgccatggcaaccggaccctcgaatgccctgtgtgtgtcgagtgtgtgcgggcgtggccgtggatcgcgcgtgtgcgccttgggccgcgtgaggggaagcagcttcgtcatgcgtgatggtgtctgccggagtcggggctaatccccaccgcacacacaggcacacacaggcaaacgcaggcacacgcaggcacacacacctccaaacgctggtgcgtttcctgcgggggtggatggggattcctcttctctattcccactatcgagccagtccctcggagccaatcccaccccgccccatcacacatctctgtcttcggtgtctttaaccactttcttacccctgagcctcagacacattcgtctcccttgcagccttaaaaagaaaggaagaataaaataaaaaccccttaaacactccttgaacacggattcctccttaggagagtgagggaacttagccgtatttactcagaacccattatgcaccaggtgcccagttcatcccagttctgtgaactcaggagtgttctctttttccggaaaaggaagctgaggttctgagggtcgaggatgttagggccaggcccaccccaacatttgttgggcccagcgcaaaataagaaatggaaatcgacatactgtgcatctaaacatttaaaagatacaaatcaaattacaatttgttaaatatgttcccctcttattttcacaaatacaggttcagaattacgaaaatgaaagacatatgtacagctacgctttctatatgactgaaagttggcaaaatatcagagctgatggaattttattactcctgcacatgtctaggtattctcttgatggatcagtgatgtttgcacaaagtagtaatacaatgtttggacaaagacacatacttcataaattatatatttattccataatatatttttcatgcctctttcagtaaaattgctaattattttaatagagatttcctttttttttttttgataggttatcattctgtcacccaggctgtagtgcagtggtgcgatctaagatcactgcagcctcaacctcctgggttcaagcgatcctcccacctaagcctcccaagtagctgggatgacaggtgcacgctaccatgcctggataattttttttctttttttttttttgtagagatggtggtttcaccattctgcccaggcttgtctagaacactcctgagctcaagtgatccacccacctcggtgccccagagtgctgggattacaggagtgtgccactgcacctggcctaatagagattttaacataacttgtgtccattgactattctaagaaactgctggagaccagcagtagcaactggaatcatcaaaaagttcttaaaacaatattcaattcagaagcaaatcatgatttttaaatgatttatttttctggctgagcatggtgactcacacctgtaatcccagcactttgggaggccaaggcgggcagatcacttgaggtcaggagttcaagaccagcctggccaacatgacaatatcccgtctctactaaaaatacaaaaattagccaggcatggtggcgggctcctcctactctggaggctgaagcaggagaatcgtttgaacccacgaggtggaggttgcaatgagccaagatcgtgtcactgcactccagcctgggtgacagagtgagattccatctcaaaaaaaaaaaaaaaatgcagcagcaaattatgattttcaaaaatcatttttctggcgggatgcggtggctcacaccagtaatcccagcacttcaggaggccgaggtgggtggattgcttgagatcaggagtttgagaccagcctggccaatatggcaaaaccccatttttactaaatgaataaataaataaaataaattatttttctcctttaacagaaagttactccttgtaataagttgaccacgaaatgggttactggaatttcattttcattcagtcctatgtagttttttttttttttttttttttgagatggagtcttgctctgtcgcccaggttggagtgcactggcccgatctcagctcactgcaagctccgcttcccgggttcacgccattctcctgcctcagcctcccgagtagctgggactacggttgcccgccactacgcccagctaattttttttgtatttttagtagagatggcgtttcaccatgttagccaggatggtctcgatctcccgagctcgtgatctgcttgcctaggcctcccaaagtgctgggattacaggtgtgagccaccatgcctggcccagtcctatgtattttttaaaattttcaccccaaaagtagtaaaacaattcaaaaatcagaacaaagttctctgcagaaaaagaaaaatacagtaaaaaatttccttgaggcttcctctttgatccatatattatttataaatgtattgtttagtttctaagtgtttggaggtttgcctattatttttctgttattgatttctagtttgagtccattgtggtcagaacacactgtgtataatttcaatttttttttttttgagatggagtctcgcttttgtcacccaggctggagtgcagtggcgtgatcttggctcactgcaacctctgcttcccgggttcaagcaattctcctgcctcagcctcctgagtagctgggattgcaggcacccgccaccatgcccggctaatttttgtacttttagtagagatggggtttcaccatgtagtccagtctggtctccaactcctgacctcaggtgatccgcctgcctcagcctcccaaagtgctgggattacaggtgtgagccactgagcctggcctcaattcttttgcatttgttgaggtttgttttgctaccctcagtcccaagcctgggactacaggcgcctgccaccacactcagctattttttttgtatttttagtagagatggggtctcaccatgttggccaggctggtctcaaactcctgacctcaagtgatccgctccccttggcctcccaaagtgctgggattaaaggtgtgagccactgtgcccaaccttgtatttttagtagagaagcggtttcaccatgttggccaggctggtcttgacctcctgacctcaagtgatctgcccacctcagcctcccaaagtgctgggattacaagtgagagccacagtgcctggccctatatgcttgctgattttgtctagttgttttatcaattgttgagagaaaggtgttgaagacttcaattgtaattgtggatttgtctatttctcctttcagttccattagtttttgcttcacatattctgtagctctgtcatttggggcataaacattaaaaactgtgatgccttgatgaattgatacttttattattatgcaatgtcactctgttcttggtaagctttttgtgtggagagctactttgatattaatatagccatttatgttttcttttgattaatctttgcaaaatatacctttttctatccttttactttcaagctacgtatatagctgtatttaagtgagtttattttagacagcatataattgggtcatttttttaaagtccactctactaatctttgtcttagttgacatatttagaccatttacatttaatgtaattattggtattacaggtgtgagcctgtaatttacatttacatttaatgtaattattggtatgttagggcttaagtctgtcacttaattttttgttttctttttgttgcctatgttcttcatttctcttttctttatctttcttcttgtttttttgttttgttttgttttgtttttttagagatggggtcttgctatgttgcccagaatggtctcaaactcctggcctcaagcaatccttccactttagcctcccaagtagctattattacaggcatgagccactacacctggttcatttctgttttatttttcctgtgctcttgttgataaagtgtttcttattctatacatacatagcttatcacagtgtaccggtattgacattttgccagtttgagtgaagtgtagaaaccttacctactattaagtccctttatcctccctcatttataattaccttaagtatttcctctatatatttcagaaccactttagacaatgatatacaatcagcatttataaaaaacttcagaagcattaaagtctatcgcatttacccacattttccttctttcagttgttttttctccctttctgacagtccaagattccttattttatcatttcctttacattttaagaacttcctttagccattcttttagagtagttatgttggtgacagattctctaagtgttccttcatctgagaatgtcttgatctcccctccatttctgaagtatacttttgctggatattgaattttggtttgacagttcttttctttcagctcttgaaaaatgtgccacttctttctggcctttgtagtatctgatgagagatcctgtttttctcttatacataagagattgtcatctctttctcaattctatgtttgtctttaactttcagaagtttgattattatgtgtcctgatatggatttctttggctttatcctgtttggcgctcactttctttaatctggagatttatgtctttcgctaaatttgaatagttttcagccattatttcttcaagtactttttaagcccatctcccctctcctctctctccatgacaggagtgttagatcttttgtaataatcctataggtccctgagactctatctattttctttctttctttctttcttttctttctttctttcttttctttctttctttctttctttctttctttctttctttctttctttctttttctttctttctttttctttttctttttttttttttgcagctctgaggtaaacttttattttttggctgacaggacttccacccccatgctcctcctggcaccttttactctgcccaagcagtggcagcccagtccaaaaggtgcctgccatggccaaaggggttgaggagtcagattctatctattttttttaagtctgttttctcttggttgttcagattgggtaagttctattgttctatcttcaagttcactgatgctttcctctatcttctctattctgacattgaatccattgagtttttcattttggttgtattttttaattctaaaatttccttgtgggccaggtgtggtggctcacacctgtaatcccagcactttgggaggctgaggcagggagatcacgtgaggtcaggagtttgagaccagcctggccaacatggtgaaaccctgtctctattaaaaatataaaaattagctgggtgtggcagcatgtgcctgtagtcccagctacttgggggactgaggcaggagaatcgcttgaaccaggaggtggaggttgcaacgagccaagatcataccactgcactcccatctaggcaacagagcgagactctgtctgaaaaaaacaaatttccatgtggtcttcatttatattttctatttttttctaagactttctatttttccatttgtttcaagtgtgtttgcaagtacttatgatgcatttcatgatggctgcttaaaaattattgacaggtaattctaatatgtgtgttatctcagtgttagtgcctattgattcttttctcattaaagttgagatattctcgattcttagtataatgagagattttcaattgattcctgaacattttgggtattttattatgagattctggatctcatttaaacgttatatctaatttaaacatgtttagcaggcctcctttgacccccagctagtgaggaaacaaggacactgccttggttattgtgagataaggatggaagttaaggtttcctactaggtctctgctgaaaccacctcaaatgaaagggaaggtggcctcactgctgggcaggagtggaagcttccaactagagactcctatgatactgctctatcaagaagggagaggagtcccatgcggtctccactgaacccataagaggtgtatctgttaatgctgggtgggtatacaagtcctagctcctcatttgacattctctgatgacaccttaatagcaggtgggagaagggtctatgtatggagttgttacatccatagcctagactagttgaatcagaattgctggggtgggactcaggcatcagcatgttttaaaactcccttgttgaatccaatgtgtgtggaagcaaggttaagaattagtgctttagaagttcctttagtcaagagactgttggcgataagctctgctttgcttatctggaaatgcttttatttcgaatcacttcttgaataataacttagtaaatatataattattttctcttacttcactttgaagatattatttcaccatactttggtttccatttttgcttatgagacatcaactggcagtcaatttgcaggtagctggtgtttccctgactgctcttaagatcttttgatttcttttggcaatcttcacttttacaaggatgtgtttagttgcttaaaatttcttgtgctttctaaatctgcacatttatgttttccctcaattaaagaggactgtcagtcattgtttcctcagttattttctttctcccatgtggtgtgatgtgctgccattgtgatgtgatggtcaagacctcccttcccccaacccttcagtgaagaatgtgttgttatagtttaggggagtgctgtccccttcagagtttgcctcaaggtcatgccccttcccagggcagcccaaatccaatgactaattaatacaggattataaaggtctagctatctcagcctaaatcagaacaatggtgaaggccattctatttgggctaaatttaaaatagttggatatgtaaaaatttgagtttggtgccaatgggcttttgagctaatgagtcccagcctgctctgaagaagtaaacaacatagggccaatatacagaggtcatctttggttcatttgcataacatggccccagcactggcactgaacatatcattatctcttcaggcattggccattccgggtttgttcaccccaggtacatgtgtgtctattcaacctgtagtttgaagcttttttatttcagaaaaacaaagaacaaaaaactgttaggccaggcacggtggctctcacctgtaatcccagcactttgggaggccgaggcaggtagatcacttgaggtcagaagttcgagaacagcttggccaatacgatgaaaccccgtctccattaaaaatacaaaaattagccaggcgtggtggtgggctcctgtaatcctagctacttgggaggctgaggcaggagaatcacttgtacccggaaggcagaggttgcagtgagccaagattatccattgccctccagcctgtgcgacagatcaagactccctctcaaaaaaaaaaaaaaaaaaaaggtatgaaagtatagttttagtgtatgttctgttctgttgctttccctttcctcttcaggaaatcctgtcatacatatgttagatcttctgcctatcttgttttttgttttgttttttgatcactttctcccaaatccttttttatctctttcttctttaaaaatatatttttttaaaatcctccatggctggtgcggtggctcacacctgcaatcccaacattttgggaggccaaagagggcagatcacctccatttaatcttctatttgtctgaagatattatccattgtcatttttgctagtgaaacttctagaatagacttcatttctgaaataacttttcatttattctaattccctcctgagttctgtaacctcacttttaaacatcttattttttccaatcatcacatttttgaatttttctcactcttatattgatttttcatagtcccttttcttttcttaatggttttcttttgttttaagggtaaatctttctgtcatgctttcactgtcaacagggacattatggtattattccctatcctcctcttttatgtatggacttcaattgagtagttttaattgcttttttttttgagatggaatttcgctcttgttacccaggctggagtgcagtggcatgatctcggctcattgcaacctccacctcctaggttcaagcgattctcctgcctcagcctcccaagtagctgggattacaggcgcacgccactacacctggctaactttatatttttagtggcgaagggattttgccatgttggccaagctggtcttgaactcctgacctcaggtgacctacctgcctcagcctcccgaagcgctgggattacaggggtgagccaccgcacctggcctaattgttcatttttaagggcaatgagtttttctgtttagaaagagcaataggaagaatagcctttttctttttttgtgtgatggagtctcgctctgtcacccaggctggagtgcagtggcacgatctcggctcactgtaacctccatctcccaggttccagagattctcctgcctcagcctgccgagtagctgggattacaggcgcccgccaccacacttggctaatttttctttttttaaccatgttggccaggctggtctcgaactcctgaccttaagtgatctgcccactttggcctcccaacgtgttgggattacaggcatgagccaccacgcccggccaagaatagcttttctagcttcaaagctttagagttttctttaccttaaaataggtgatacaaatgtgatctttgactcccgagacaggcatcctctactacgccacctacttctatctggaccttctctctctctctctctctctctctttttttttttttttgtccttattgtctctgctaagttctatttggattctactgccagcagtttctcctctatttgggctttgtcttggaaggaagtgttgatttgttagtctcaagatctcataaagttcagaccactccaatatctccagaactttaaaaattagaacagaaatcaatgaaattgaaaacagaaaataaagagaaaaaaatcaacaaaatcaaaagatgattctttgaaaagataataaaattaacaaacctctagccaggctaaccaagaaaaaaacaagacacaaattattaatgtcaaaaattagagatggggctcactcctgtaaccccagcactttgggaggctgaggcgggcaattgcttgagtccaggagttcaagaccagcctaggcaacatggggaaaccctgtctctacaaaatataaaaattggctgggcttggtggcgcatgcctgtagtgccagctacttgggaggcttcggtgggaagatcatctgagtttgggtcggtcaaggctgcagtgagccgtgattgtgccactacactccagcctggacagaatgagccccagtctcaaaacaaaacaacaacaacaacaacaacaacaaacagagataggccatcactactgattccatgagcatcaacaagataataacgcaggctgggtgtagtggctcatgcctgtaatctcaccactttgggaggacgaagcagccagatcactttaggtcaggcgttcgagaccagcctggccaacacggagaaaccccatctctactaaaaatacaaaaattaggctgggcgcggtggctcacgcctgtaatcccagcactttgggaggctgaggcgggcggatcatgaggtcaggagatcgagaccatcctggctaacgcggtgaaaccccgtctctactaaaaatacaaaaaaaattagccaggcttggtggcgggcacctttagtcccagctactcgggaggctgaggcaggagaatggcgtgaacctgggaggcggagcttgcagtgagccgaggtagtgccaccggactccagcctgggtgacagagcgagactccatctcaaaacaaaacaaaacaaaacaaaaaaaattagtggggcgtggcgacaggtgcctgtaatcccagctactcgggaggctgaggcaggaggagaatcacttgaacctgggaggcagaggttcagtgaaccgagatcgtgccactgtactccagcctgggcaacagaggtagtgactccatttcaaaaaaaaaaaaaaaaaaaaggataataaaggaatattatgaagaattctatgcccacaaatttgtcacacaggctaaagtgcagtggtgcaatcacagctcactgcagcctccacctcctgggctcaagtgatcctcttgcctcagtttcctgagaagctaggatttacaagcatgtaccaccacacctgggtaagttttttttattttttgtagagacggggtcttgctatgtaggctagggtgactaatttgtattatttcttttctctccttatttgaaatttaattttctatgtctagtttccagaagtggaagccgattattgattttatatctttctccctttggaatatatacattcaatgctacaggtttctcttgcagcattgcttttactacatcccacaaattttgataagttgtatttttcgttttcatttagtttaaaatattttcaaaatttctcgagtctttttttcttttttgaggtggggtctcactctgtcacccagcctggagtacagtggcatgatcatagctgtattagtcagggttctctagaaggccaggactaataggacagatgtacatatgaaagggagtttattaaggagtatcgactcaaacaatcacaaggtgaagtcctacaataggccatctgcaagctaaggagcaagaagccagtctgagtcccaaaacttcaaaagagggaagctgacagtgcagtcttcagtctgtggccaaaggccagagtccctggcaaatcacttaagtccaagagtccaatagctgaaaaacttggagtccgatgtttgaaggcaggaagcatccagcacaggagaaagatgaagaccagaagactcagccagtctgtccttccacgttcttctgcctgctttattccagctgcactggcagctgattagattgtgaccactggattgaggatgggtctgacttgttaatctcctttggcaacatcctcacagacatacatatggaggaacaatactttgcatccttcaatccaatcaaattgacacttgatattaaccatcacaatagctcactgcagccttgactgcctgggactcaagtgatcctcccacctcagcctcccgagtagctgggaccacaagtgtgtgccacgcccagctaatttattattattgtttattttattttttttagaaatggggtatcactatgtttcctaggctggttttgagtgtttttctttggcctatgtattattcagaagtgtattggttaataagctactccggagactgaggcaggagaatcgcttaaacctgggaggtggaggttgcagtgagctgagatcgcaccactgcactccagcctgggcgacagagtgagactctatctccaaaaaaaaaataataataataaaagaaaagaagtatattggttaatctttaaatatttgactattttctagctatatttctgttattgaattctgtttaatttttttgtgatttgggggcatacaatgtatgatttcaagctctttaaatatgttaaggagtgttttatgcccaaaaatgtggtctatcgtggtgaatattccgtgtgaacttgaaatgaatatatagaccaagttgactcatgttgctgttcacttcaactatgtcactaccaatcttcctcctggatctgttaactcctaatacagggctgtcaaaaactccaactataatagcagattgtttatttctttttgcagttctatcagttttttttctctcttatgtattttgatactagggcatacccataaaggattatgtcttcttgaagaactgatctctttatcattgtgtaatggccctctctttatcctttttttctttttttttttttgtttgtttttgagacagggtcttgctctgtcaccaaggctgaagtgcagtgttgttgcaatcatggctcactgcagcctcaaactcccaggctcaaatgatcctctagcctcacccttctgagtagctgggactacaggcacataccaccacgcctggctaacttttgtattttttgtagagatggcatttcaccatgttgcccaggctggtctcaagtgatcctcctgcctcggcctcccaaagtacaggggttacaggcatgaaccatcacacctggccctctttatccttcataattttccttgctctgaagctgactccatctgaaactaatacagctttattttttctttcatagagatgggggggtctcattatattgcccaggctagtctcaaactcctggccttaagtgatcctcccgcctcgacctcccaaagtgctgggccaccatgcccagcctccagccttcttttgattagtgttagcatgatgcatctttctccattcctttacttttaacccatctgtgtctatatttaaagttgatttcttacagacaacaccagttgggtcttttttttaaattattattattattagagtcagggtctctctgtcacccaggctggagttcagtggcacaatcacaactcactgcaggctcgacctcctggggtcaggtgatcttcctgcctctgcctcagcctccagagtagctgggactacatgcacgcaccaccacaccggctttttgtactttttatagagatgcagttttgtcacgttgcccaggctggtcttgaactcctgggctcaagcagtctccccaacttggcctcccaaagtgctggaattacaggcacaagccactgagcctggccctttttaaaaaattcatgtatttagaccattgataaaattgccattgctatttcttttttctttctttttttgtcttctttggttttaactgatcatttaatataattccattttctcttttctgttaatatagcagttatacttttttgggggcatagggtctgactctgtccctcaggctggagtacagtggcacaaccatggctcactgtagcctcaacctcccaggctcaagagattctcctgccttagcctcttaagtagctgggactacaagcctgcaacaccatgcctggctaattttcaaaatttttttgtagagacagggtctcactatgttgtcccagttgctctcaaactcctggattcaagtgatcctcctgtcttggcttcccaaagtgctgggattacaggtgtgagccactgcactcaatccttctctttaaaaaaatttttagttgctgccctaaatttcacaatatacatttataagtaatccaagtctccttttctcttgttttctttctctctctctttcattcctttttctttcgagacagggtctttctctgtcacccaggctaaagcacagtggtgcaatcatagctcactgcagccttacctcccaggctcaagcaatcctcctgcctcagcctcctgagtagctgggctaatttttattttctgtagagaatacaggtcttgctatgttgcccaggctggtcttgaactcttggcctcaagcaatcctccccatcttgttcttcgaaagcattgagattaccaattcctctctcccattctttttttttttgtttttgtttttgacaagaggtcacccaggctggagtgcaatggtgtgattttggctcactgcaacctctgcttcctgggttcaagcgattctcctgcctcagcctcctgagtagctgggattacaggcgcatgccaccatgtccagctaatttttgtatttttagtagagacggggtttcaccatgttggccaggatggttttgaactcttgaccttatgatctgcccacctcagcctcccaaagtgctgggattataggcataagccaccacgcccagcctcattctttataacattgttgtcatgtatttcacttattcataaggtaatcactgaatacattgctggtattattatttcgaacaaactgctatttgttacatcacttcagattaagaaaaataaaatgttttgttttatcttcatttactccttctctaatgctcctcctttcttcctatagccccaagtttttttcatatagcccctagatcattttctctctcttcaaagaacctctttaattttcttgcaaggcagatctactggtgataaattttctcaagtcttctttgtctgagaaaatctatttcttcttcacttctgatggataattttgctagaaacagaattctaggctggtgggtttatcccccctttttttctttcttacatatttcacttcactctcttcttgcttgcatgttttctgaagagaaggccaatgtaatccttatccttgttcccctataggcaggtgttatttttctctggctcctttcaagattttgtcttcgattttctgcagtttgaatataataatctatagatatagattattacttggcatttatcctgcttggtgctatctgagactcttggatctgtggtttgttgcctgttattaattttgtaaaattcttgattgttattactcccttattattctcttcatgtgcctggttatttctgattatatgataggcattgtgtttgaaaaatatttttagaaataattggaggtctaggggtacgttttccttctacagaatggatatacatttgtttctggaaggcatctaggggctctagcaatctgagataatcaaactaattttagtgattgagatgactcatatctgagcagtttctgagcaatgaatggtctgttttcaatttatcttgtagagtttggtcttttgaggtctcaacccaaaaagtggagagttttccagggtcctttttgtgggcccgggattaaaactttatttctcattttatttacttattttttcctacctcctggaattataaggaatggactacaacttttaatccccaaccctgtgaggttgtcaaaagtgcttcagagcattttatcagccttatttggaattggcaattgcacccagaagagacatgcccccaaatgctaggcttactgttcagggttttagtctttcttacatctcatccaagtaatgtttcataatattttactattccaatgccttcaagcttttctaattgtctccagtggtaagattgttccaaattacctagtctaccactatgagaaagtagccttcatatatatatatatacacacacacacacacatacatatacatatatatatacacatatatatacacacacatatatacacacatatatatatacacacacacacacacatatatacatatatatatatttttttttttgagatggagtctcgctctgttgcccaggctggagtgcagtgatgcaatctcagctcacttcaagctccacctcccaggttcatgccattcttctgcctcagcctcctggggagctgggactacaggcgcccgccaccacgcccagctaatttttgtatttctagtagagacggggtttcaccttgttagctgggatgttctcctgacctcaggatctgcctgcctcggcctcccaaagtgctgggattacaggcgtgagccaccgtgcctggcctatattttttattttattttttgagacagagtctcactctgttgcccaggctggagtgcagtggtgcatcttggctcactgcaacctccacctcctgagttcaagtgattctcttgcctcagcctcccgagtagctgggattacaggcgtgcaccaccatgcccacctaattttcgtatatttagtagagatggggtttcactatgttggccaggttggtctcaaactcctgacctcaggtgatccacccaccttggcctcccaaagtgctgggtttacaggcgtgagccaccgcacctggcctgccttaatttttgaaacggtttttatctttttcttgtatgtatatctgtagtatttttactcatatttgaataaatgtaagaaaatttgaataaaatgaattttcctgaaccagcgattagcattaaattcaggtagtttggagtctttaggctctttcttgtttcactagtttgtgcctttttgtttttaaattcaccttgttgctctgtatggtttttacagaagttggaagattaaaaaccaggtttctaccatgttcctataagaatctgaagtctcccaatttgttacataacctctgtatattttcaggttgctgtatatgaataagcctctttttgggttctgcattctgttttatggggctttttgtctatttctgcaccaataccaactgtcttgataattacacttttataatgacttatttttattttttaatttttaagagatagggtctcactctgttggccaggctccagtgcaatgctgcaatcatagatcactgcagccctgaactcaggctgtagtgatcctactgccttggcctcccaaagtgctggaaatacaggtgtgagtctgtgacttcatatgagggtagctgaagatacactgagtgtgaatgagatcactcaaagtgtatactggctggatatcaactctattccatgttgtacatgtttttctttttttctttttttgagacggagtctcactctgtctcccaagccagagtgcagtggtgcaatctcggctcactgcaacctccgcctcccgggttcaagcaattctcctgcctcagcctcctgagtagctgggattacaggcatgcgccaccacgcttggctaatttttgtatttttagtagagaaagggtttcgccatgttggccaggttggtctcgaactcctggcctcaagtgatctgcccgcctcggcctcccaaagtgctgggataacaggcgtgagccactgcgcccagcttatttttctcttcttaaaaattgactttttcattattcttaggaattcttgcacttactttaaaatcaatttcaagtttcccccaccctaaaaaagatttgcacttactttaaaatcagcttcaagttccaaaataaaaagaaattgaattttaataggaaccatattgaacctgcagataaatttaaaatccttatgaatattgagtcttctctttcatgaacatgttctgtctctacatctctatctcctgtgtctctccaaaatttagtaattttctccacaaagtccttaggtcttttaatagatttatccctaggatcatataattatgtactgttgatgtttatctaggctgacataagtcagaattttgaatgtgtatgtgaagatgtataacatgacacaatgttttacctttttttgcacaatccagtttgagctatttccttgtaactaatataggtagagtgtcagaaaatgattatggagtggtcaaaggcatcatcttgaagaggaagactggcgtatacttctgagtgaactggacaatggggcaaagcaggaaacacgtaatctgacttgcagtttaaaaagatgactggaagaactgaggcagatgcattcattaggatcctaaacaaagatggtggcagtgtagatagagaggagtacatgaatctaagagttatttatacagagtagggatgttgtggtgacaattatgacaggaaggaaggagttaaagatgattcccagacttcggctctaatgaccagcagaatagtcatacaggaggaatagagtggggagctatgaaaagatgaattctgcctgggacatgagctttaagtacgtaatggacattcagatgatatgaagatgttggctacctgagcttggaccccagaggaaatacacatacatatattatatatatgtttgtcggtcagtctatcatctatctatctatctatctatctatctatctatctatctatctgtctaatctatctgtctatctacctacctacctacctatctatctatggctgtccaggtgtaagactgcacactaagactgtctaaatgagatcactaggaagaaagtataagaggaaaggtaaggtgctgtggctcatgcttgtaatcccagcactttgggaggctgaggtgtgtggatcacctgagttcaggagctcaagaccagcctggccaacatggcgaaatcctgtctctacaaaaatgcgaaaaaattagccgagtgtggtggtgcacacctgtagttccagctacccaggaggctgaggcaggagaatcgcctgagactgggagacggaggttgaagtgagctgagattgcaccactgcactagggcctgggcaatagagcaagagagcgagactctgtctcaaagaagaaaaaaaaaaagaagacaaaaccttggttatgggctgagagtttactgaaggagtcagtgatagacattgagaaactcaggaaagaatggtgtcacaaaagcctgcgaagaaagaatttcaaagagggagggatcaaaatctcaaaaatatgcgaaaagatcaagtaatttttttccttattattgagcaatgtcccttgatttggcaacatgtaggttattgttggccttagtggaagcggcccttatgaggattacagcccaactgtggggtcatgagggctgaatgcaaagtggtgaaatagacaaacttgcaactgtttcaggcagcttgactaataaaagtggactgagaggttttaattttatttgtttaaacataggagaagaaatggattcgagcccagaaatagctgagttgctagctttatctgtatgtctgtatttggtgtccgagaggaggaagatgtctgacgtggggcagcccaggacagtggctgaaggcagtaggggctagagttaggtagctgagttaggagtcatatgccctgcaactccccagtgctaatcgggactcagcgtagctgtgtaaccatatagatgtcacttaaccttcctatgtttgtttccttatctgtcaaatgaggataatattgatagcacattggttgggatgaggattaaatacattaacatccagtaaagtgcttataatagtgcctgacaggtcgggcttggtggctcagcctgtaatcccagcactttgggaggccaaggtgggcagatcacctgaggtcaggagtttgagaccagcctggccaacatggtaaaaccccgtctctactaaaaatacaaaaattagcagggtgtggtggcacatgcctgtagtcccagctacttgggaggctgaggcaggagaattgcttgaactcgggaggtggaggttgcagtgagcccagattgcaccactgtattccagcctgggtgacaagagcaaaactccatctcaaaaagaaaagaaaaaaaaaaaaaaaacaacaaaagtgcctgacacagcaagcacataaaaatgacgaagcacttttgttctcctagctggatctccacatctatcttcattcagatttctgactcatgtgagtctagataaacaccagcagttgagttcctatgttcaaatatcctctttcataatagatcatccagacactcagacacacgctctcactcacacactctgcagcacaccagcgagcatggcaccccttcccatctgtgtctgcctgccagctgctcttcctcctttcccacacacactcccttttttgagtggcttccaaaacatctctttctaatttgctataaagagtgagccataaagaatttattaagtgatgaaaaaaatcacagctaagtatcagattctccagaggaaataagattaaaaagaaattctggaaaacagttgtttttggagaagggaatagcattgggaagggggatattaataatgtttcatcttttttgtttaaaaaaaacaaatctgaagcaaatatgactactgagatgcaacaaagctgggtggttacactgtttactattttctagacttttctgttgtttgaaacatttgaaatcactaaaaaataggagtatttactgggatagtttagactaaacatgggtgtggttagagtacagtaattactgtgaaaaaagcaaggttcctggacatttaaatttttttcttttttttgaaacatggtctcaccctgttgctgaggctggagttcagtggtgtgatcatgactcattgcagcctcaatcttccaggctgaagtgatccttctttctcagcctcctgagtagctgggactacaaccacacaccaccattcttagctaatctttttaatttttagtagaaatcaggtctcaccatgttgcccagggtggtctttaactcctgagctcaggcaatcctcccacatcggcctcccaaagtgctggaattagaggcatgagccactgcacctgaccctgacatttcgatttttaaaaattttgttgaaaaacgtcacacacacacacacacacacacacacacacacctgcttcaaagaggatttttaaaaacaatggtggctcggctagaaaagatactaattttcaacctttatttcaaagtttatttataaaggaaatacaaattttgataaacaaagcacccaattcctacttattttttttcttcgtggaaaaaaaagtatgtgacacatacttgtcatgccctgtattgattaagcttacaaaagatattgacagaaactatacaaatctagaatttagagtgctaggaatgttgccataaggtatgtgtacctacattaatactaaataaattccacctacatcctttctttcaccctttcccagtatcatttcagctttcctcacagtctcactgtcccagaagtctaggggcaatgactctccatcactagtgctgtggtggcacctgtgctcccacatcctgatatcctacccctacggcaatcctttgagaagcacctgaaaacaccagtgacctagctttattagattcctcgaagggaaggtacctggcatgcagcctcagctcctaccaaggagaggagaggttgaagactctcccagtctccattcactcctttgctttgatacccgttaggcctgctttgcctccttaatagactcctggaatgggaaggggtgggggtggggagcgactggagaactcttttcctaggatgactggagccaggaagtcagtctggaaacttccccaccccctggtggtgcacagcacacaagatggcctgtgttccgctcaggggtgggactttcaatttacagcctaggtgaagggagatgagttggggcaacagcgattctgttcattggaacagactgggtggtaactgcaggccactgcagttgacctgttggcattcgaggtctgacgaccttcaggtaaatgctcttatgatcagtggaccaaaggagcaacggtggagggtgaggaacagcacactttaccaatgaaagtcgtgaccaggccacgttagtttagtggtaaaaataataacattaaagaaaatgtttacaacaggaatagaaaatgacagaaccctactgctttaactcaagtgtatcacgatctctgccttcatccacttgagacttaaaactcagtgtctgctatttttacttaacattatcccaagcaatagtaacatgaaagttatgaccaggagggaagcagggtcgcacctgtgcagggtccttgtctgcggaccacccctcctacaagcttctgggtaatagaggtaagggggctcctgtggtgggtgccagtgctgggaccttaacttgtgtatctgggctatagccctggacttggctaggctgggctgtgtgaaaattccaagaattctgttggtagaaaatgcccaccctgtccttacaggaacagcacaaggctaggcttgtctacctcccaccaggacctcgaaggaacatgacccaggggctgaaggatggtgttgaaggaccgagttttactcagatccttctcagccctgccttcctgaagtttctgtatccactacactggaagctttctgaaaaaaatgcctggaacctgtccattgttaccccagcccagggcccagccaaagaacttaacaaataaccgccaaggaaatcctcacctaaaatggctgcgatgcattactgcccccgcctctggcttacagtatcacttctgcatctgaaaccaggagggggcagtctgggtccacgacgagacatttccttctagagaaaatcacacctgcaaagaccctctccagagccaccgcccacctccgcgcagccatccattccctgcgaagatgctttgggctgaaaatggttgggaggagggggatggaagtcgcctacgttattttggaattgaccagggcctctgagtccttcaaattcaacaatttaccacaggcccgcgtgcggtggctcacgcctctaatcccagcactttgggaggccaagacaagtgaacatctgaggtcatgagttcaagaccagcctggccaatatagtgaaaccccatctctactaaaaatagatgaattcggccgggcgcggtggctcacgcctgtaatcccagcactttgggaggccaaggcgggcggatcacgaggtcaggagatcgagaccatcctggctaacacggagaaaccccatctctactaaaaatacaaaaaattagccgggcgtggtggcgggcgcctgtagtcccagctactggggaggctgaggcaggagaatggcgtgaacccaggaggtggagcttgcagtgagtcgagatcgtgccactgcactccagcctgtgtgacagtgagactccgtctcagaaaaaaaaaatatatatatatgaattagatggacatggtggcacgtgcctattaattccagttactcaggaggctgatgcacgagaatcgcttgaacccaggaggcagaggctgcagtgagccaagattgtgccactgcactgtcagcctgggcgacagagtttttgagacagtctcaaaaacaaaaacaacaaaaaaacccactaccacagtgcctagagaacaatatgtgtttaataatatttaaataatggttgtataaaattgaagcagcaagaaacccaaaggagaatagctctaggggagggaggtggatgagtatgcatgggggagaggctcttctgtgaccaggttgggtctggagccctccccactgtccagaacacctccaagcccctacatctttttccatataccaacgccttggagatataatgcagaagtgaagtgagcaggctgaggattagggcaggtgtctggaatatggtcaggagtgggaggggagtgacatagctcacaggcaaggcagaacagcacaaaggctataggtttcattcccagccctcaacttaaaagacctcaggggcagacactgactccagcctggctgtgcccttaccctaacgccattcacacttttttttttaaacacaggtaatccatgtttattatagaaaaatgccacattactctttattgaatgcgagcgccagcaccggcccctttctctccaagcacaggggcacgcaggcaaggggcacgaaggcaaggggctccgtcccctggccaggatgcagtggaagcctggctccactaccattcacctacagccagcaccctcctcggtgcctggggctcaggtctgttcaaactcctgctcacagaagcctacattgaggggttgggcctggacacctcgcctgcaagaggacatgaagaaatggcaagataagcccctcagaaggggccccagcaacacttttcacaccagtcaacagtctctccttccccatttcggtgactctcaaactgtcactgtacaccaaatgcacctgggaatctcaattccagagattctcacctggggtggggcaaagtattggcaagaatctgcaagctgaacaggtgcctcaggtgattctgatacaggtcttggagatccagaaacgttggcgacatctatttatatcctgcccatctctgtaccctaaccccaaataactcaatccctttagaatatagatggatgtctgaaaggcagccaatgctcttggtctacttagccctctgttcctgactctaaaatgctgtaaatatggtggcactgggggacttaggtgctgtcctgtccatgaacatggatgcgaaatcctgtccttgggtctcagtctataacctgaccaatctccttaggggacctctaggcatgcttcccttatcatccaagtaagcaacatgcttagagaaccagctggaagttacccagtgaatgacataattgaggcttagacaccatcatgcttgactctcagcccaggactctgctctgcactaggctatgtcccccaagtactcaagacctagccaacgaaggaatcagggaaatgactatcttacacaggcacatccctgacagaggcaaaggtgtcatgacatcctgtaagtcagcctggttcaaatcctgcttcttagtgactttgggcaaggtcctgaactctgtgcttcagtgtctatctctaaaatgcacctgtctcatggggctgtggtgaagactaaatgagacaatatttgtaacaaacttagcacagtgtttgccacaaaatacagttgtccctcagtatccacaggggatttgtttcaggacccccgtggataccaaaatccaaggatgctcaagtcccttatataaaaatgacatagtatttgcatataaccaatgtacaacttcccatatacttgaaatgatcttagattacttatacctaatacaatataaatgctatgtaaatagttgttatacagtattttttatttgtaccattttttgttgtattttttttttcctgaatactttttatcgcagttggttgaatccgtggatgagggctgactataagcctctgtaagtgttagctattgttaattattgtcttcctctctctaaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaagccttattacaggaatcatggatgcttgtgctgggtcttgagcaactcacctatgttctccaggcctcattatctctctgggaagtaaggttaacaatccctatcccacataccaaagggcagctggagggatatagacggaagtcatgtggagagtgaatattgcacacaaatcttcagaaggctcgttgcacggcctgctctctctcaggcctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtacctgagggaaaacaagcaacaacagtctggtgatggtggggtaactccagggtccctctcaaccaccttcccaatgtggccctcaccccagctaagttgtttcatttactaactggaaatgtctggcccagaccttcctgcctcccatcctgtgccccaacccagcctcctttggttagcaaggagagctctctgctttcaccttcaaatgccaggggttccactatgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctgttataaaaggtcaaatggcagtaaggacacaaagctgaggagattcctgggccttattcatacacaggcaacatgggacaacaggtatgtgctccctctgttccccagcagcaaagtatgtctctgtgactcctgaccattgagctcacacctcaggacagaggccaaggaatccagggccctaagaggcctccctgcagctctcctccccgtccctctgcagcctccctgtccacacagagctagtaataccagctgtgagctgagggaggcaagcagtgggacccaggagctgccatgtccaaaagtctccagatgtttctggggacgggacaaggttcctgaagagtccttgcatgtgacaggagactgggatcttactgatcaacaataaaggagaaggtaaccttggtcccacagacccagaagaccctcatctatgatttaggaagaaaaatccagcctatccaagtaacctaacagcagaaatagttcttaattaagtttgtagtgagggaagatagaaactctgacacataaacccagggctcataccacagcggcctttggtttttttgaggcagggtctcactctgttgcccagggttgagtgcagaggcacatcttggctcacagcaacctctgcctcctgggctcaagcagtaccccaacctcagcctcctgatttttgtattttttgtagagatgagggttttgctatgttggccaggctggtcttgaactcctaggctcaagcaatccccctgccttggcctaccaaagtgcttggattacaggcgtgagccactgcacccagcactctgtggcctttctagagagaaaaggagagtgctccgaccattaaagcccaatccaaaccaggaggatcagtctctgtagaggcagggaggagctggggagaccagagggaggcactgctggtggcttcttctcttctctgccccggctcacctttactttattatcaaacacctcctgccacaccacatagcccttgccataagaagagacgatgtccagcagcctggagaggagaggagtgtctagtaagtgtctgcttagctcagatgggttctagactgtttgtgccagtgctctaggggttgagcctggccaggggcctattcctcattaagcagtgtctttcccctgggctgaaaaccaaccactccaaatctgaaaggatgggacaaaggacaagggaaccctgcagggaccagacagtggccaagcagggcctgactcggtatggaaagggaggaccccacaggaggacccccaagggaccccacccaccctccttccttcctcacgtctggatgtagaaggactccagctgcttgaagtcctcaccgaagcctttcttcctcataaagtcctggatctctgggttggacttcctgaatcccaagagaaaatgaagattaatctttcaacatcctgaaagcctaatgcctggggattagtcacctggccccctataacttcctcttttcacctgaaaaatcaaataagcaaggatctcagaagccctacatgtggaaagtgtggccaagcaaagttatgtgaagcaggtgggctgttgacacaggctgagaaaggctgagtctggacctgaagagttttaagttcaaactcccaaagagaaaacatattaatcctctctggactgcaacatgagaatccaaggtcttaacttgaagctccagcacactggatttcggctttcctatctgctcttccagttggatgacaagccttgctgtctaacacctgctgcagatcccttgcgttatgacgtccacattttgctcacattgttctccttctggaatattttcccctgctcacatctccaaaaagccaaattgatttccccagattcagctctagcgccctcttctcaaagaagcccctcagcctcttttgagcttactagaaccaagggtttggactttacaactgaatactaattagacattgtcacctattagtcttgaattctgtgtcttgactcttcaactagacaattttaagccttcataaacagggattatttttctctatcccgaacttttccaagacaattctgtgcccagggctgttttttctatcaatacctcaaggatatgagagtaggaaggaagaggttcacagtgaaagccttgccaaaatcaggtaggatctctacgtagatgggcagaggaaggcctaagacctgagcaatgtgagcccatacagacccctgagagcagcagctgagctaagcagcccctcgggtgctaacttctattctgagtaagcaactgatcaggccacagtgggaagatcaaagggctcataccagcaggtgaaatcaacctcatctcctccaagatgaagataaaaatctgggaagacagagctgacttctaagaagaatgtgctcatgaactcataggtattattgagactgggattcactggtccaaaggtgccagagggctcagacccagagtagcaaggagtcagtaatccagggatacctaagccaagagaaaaccccatatgagtgtcacaaatacataaacccccacgcacagtcctacacgtaaggacacgagtcacacaaagcaagacaagtgtattcataaacatcacacacatttaggtaggcacacttaggcactcacagacactggtagtcaccaccatttagtcacagtaaaaagatacaaatatatccacaatcataggcagaggctaagttccagccagacaactgtcagtgcgcacactcttgcctggacacactgcttctagcaggtgctacccttgctcccaaggctgctctcctcacaggccttgaggcagagagagagcctaatccagccaaactggcaaaatctttcttctctatctcctcctgtaggtggggtcaaccatcacccagaatctttttacatttgctaagggatatctcccttggcccagagactacttcctgacgctgaggtcacaagatatcttcagggtttttttttggttgttgttgtttgtttgtttttgagacagagtcttgctctgtcgcccaggctggagtacagtggcatgatcttggctcactgcaacctctgcctcctgggttcaagcgattctcctgcctcagcctcccgagtagctgggattacaggcgcctgccaccacgcctggctaatttttgtatttttagtagagatggagtttcaccatgttggccaggctggtcttgaactcctgacctcaggtgatccacccgccttggcctccaaaagtggtgggattacagacatgagccaccacgcccggccaatatcttcagttttctatcaggccagtagcccttttcaactgtcatttaacctgtgttgggggctcacactggagggctgagggtatacagaagaaagggagcaggggtactgactgactctgacctctgcaggctgcccttgggcttctttctttcagattctaccctggtggtcagattcctcagcatccactctaggcacaactacctgcaacggcatctgagaaaaatgtgcccttacatagtctaacagtacatattttaatagtaagaagcagcctccattgtccaaagtgagttcttcctatctaaattcccaggtggaagaagtcgatggaaaacattcttctaaggaccaaggctgggatatgccacttccatgagccagtgccctgaagcttcactctgagcataacaagcagagtccctctggtcccagacatcattcttacctggtccccaggacaaagtgtggccaggagtgtcaaactctgcaagcacacggataccccggagccgtgcgtattcaatgacctccttcacatcctgtgctgtgtagatgtgggtgacagggttgtaggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaaggtcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggttaaagtgcacactgtgaacccatcacagtctctccggtttcagcctcaaacttgcgatgttgggcgagctctcaggccgctccacacacccctacaggcttgacctgcctcagctctcaattaagtatttatggggtctatcaaaccttcccatcagggagggatggcatggagggaaggcccagcacacttctacttttcccagaacacatccaaagatggatgatagaagtggtctttcctcttcttgaaataaattctggccacattaagaggagggctgcagctactgtggtagcctggaatcttccaaaagcctgaagatcaatacttcctcttgccatttgtgttcggttgtctgactgatgttaagcccaactgtgagacctcctgggaacttagtagcctcttaactcataatctcagaagcaaaggctggcagatgtgtggcctcctttggttccgtcacaggagcaaaggaaaaggcagacacaggaactggattgggaactgtcagataagactgcacattaaactcaagagagttaggaacttccccaggaaaggctttttttttttttttttttttttttgagacagagtcttgctgtgtcacccaggctggagtgcagtggcacaatctcagctcactgcaacctccacctcccaggttcaagtgcttctcatgcctcagcctccttccttccttcacttatttatttatttatttatttttgagacagggtctctgttgtccaggctggagtgcagtggtgcaatcacagttcatgcatccttgatctccccaggctcaggtgattctcccatcacagactcctgagtagctgggactacaggtttgcgccatcgcgcctggctaattttttgtattttcagtagagatggggtttcaccgtcttggccaggttagtctcaaactcctgagctcgggcaatccacccgccttggcctcccagagtgctaggattacaggtgtgagccactgcacctggccccaagttaaggctttgaacgtctctctcctatgaccttgttctaactaaagttagctctgccggccaggtgtagtgactcatgcctgtaattctaccactctggcaggccaaggtgggcagattgcttgagcccaggagttcaagaccagcctgggtaacatgacgaaaccccagctctacaaaaaatacaaaaaaaaaaaaaaaaaattgagacgctgtctcaaaaacaaatatagttagctctgccaatgaagccaattcccctaaacatttgtatccctggaaacagcctgaacattgatctacagtagcctgtaaggtagatttaagtcactctgttattttttgagtcttggagcagctcatcttctacatttttcccaggagctcatagaattacatacaatttttttttttttttttgagacagcgtctcactctttcacccaggctggagtgcagtggcgtgatctccacccactgcaacctctgcctcctgggttcatgcgattctcctgcctcagcctcccaggtagctgggattacaagcatgcaccaccatgcccagctaatttttgtatttttagtagagacagagtttcaccatgttggccaggctggccttgaacttctgacttcaggtgatccgcccacctcggcctcccaaagtgttgggattacaggcatgagccaccacacccagtccatacattccctctctaactctttaagaatttggaacttggtctgtccgttgctccatcaccctagaactcttaagtgtgaagaaggccttaaggcctggttaccagagtgtccaggatgctagagagtggcaggtaatggcgagatgtatccaacagcaagccccggtgaggaaagcggggaaagtcctcaatctcagtcttgttgataaagaactgtgcagaacaaacattgaacatgtcagtttcaaaggaagcttactatgggggcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgtaagttccaagattcttcaccctccacagactattaatacctacttggaagtatcactctctccagcccacagatgaatcctgaatgttcttccttcctctcattcccatcccatattttttgggtaaaagttgtacccatctttttttgggaaaagctgtagttaaaaattttctattttcccctacttttaaaactgatctgtccctcccaaccctatccccactggaaagagaacatctccctaaaattctagatctcaagggataactttagttataacattttgcacaattttccaatttttttgtaaatacataaatttattaatttttaaaataaaaatgggcccaggctaggtggctcatacctgcaaccccagcactttgggaggctgaggcaggtggatcacttgagttcaagagttcgagcccagcgaacgacttcaaggttcgccagtcaacatggcgaaaccttgtctctactaaaaatacaaaaattagctgggcgtggtagcaggcgcctgtaaacccagctacttgggaggctgcggcaggagaatcacttgaacctgggaggtggcagctgcagtgagccaagcgaccacgccactgcactctagccttggtgacagagcgagactgtctcaaaaaaaccccaaaacaaaaaacaaaaacagaaaaaaaaaatgggatcctaatactattagtttgtaacatttttccccttaccaaaatgagctgtagatctgttaatgtcaatatatatagatttacatccttcttgtaaatgttgaatataattccaatgatgagatatacattaacttacctaacttctcttctgtttgtagacattcggtaatgtttataagtttttagtattataaacaacactctagtaaacaaatattcatatatatgtatataagcaattgtgaaagatatctgtaggataaattcttggaggtggaaatgctaggccacaggtaagaaaagttttggttttgatactgccaaattcctcttccaagttactgtactgacttacacccaaatccacatatatgggcccatctctccacatctttccaacactagaacatctcaattctttttcaccattgccagctggatttaaaaaaacacatacattgtttcaatttcaatttgtatttctttttaagttttaatttaattttttttttttttttttttagagacagggtcttgctctgtcacccaggctggagtgcagtggcacaatcatagctcactgcagcctcaacctcctaggctcaagtgatcctcctgcctcagcctcccaaacagctaagactacaagcgtgcaccagcatgtcaggctaatttttatttttattttttgtagagacagggtctcactatgctgcccaggctggtcttgaactcttggcctcaagcatttctttgcatttactagccaaattttttttactcttttttttgagacggagtctcgctctgtcgcccaggctggagtgcaatggcgcgatctcggctcaccgcaagctccgcctcccaggttcatgccattctcctgcctcagcctcctgagtagctgggaccacaggcgcacgccaccgtgcccggctaattttttattattattattatttttagtagagacgatgtttcaccatgttagccaggatggtctagatctcctgacctcatgatccacccgccttggcctcccaaagtgctgggactacaggcgtgagccacggcacccagccattctttttactttttaaagttacttttcttttattgacttgttgcaaatatctgcctcattttatcccttattttttaaccttatgctttcttttgctttaatttttatgtagtcaaagctatgactcttttcctttacggtctctttatttgcttacttagaaaggcctcctctacccctaaaattataataatagtttccttcatttctgtctaacacttcaatggtcttttatcttcagatctttaatctccctggaatttacttttgagtttgatatgaggtaaggatttatttttttcccaattggataaccagtcatccttaggtatttattgactaatacatcttttcacatttgatcagaaatacttctttgatcatatattaaattcccacatatatacacatgcttgcttgtctctggaatctattttcttggtaatcttattgtcagggaaatccgccatgtcatatctctaccatattttgtcactttgcccaatatataaccccctttgctcacttctggtcctgcacttctatttttatacatgttgcttcctcttctccaccagaccacctgtgtactacatatcattcaccttgtaaaccctctgagatcttgttgtgtagttacttaattactcagcctcttctacttcctccctaactgaagcctggctctccccaggaataccacacaccacttcccctacaacatgctctgagaggcagccacttcccacatcatagggttgagatatggggctgcttctgggtcatccattccaccaccaccaagtaataaaacacctttcttctgtggttcatgtcatccagctgttaaatcttcagctctccttgttacaacactctgtagcttcctgatcacttctttattcacttaatttttttttttttttgagatggagtcctcctctgttgcccaggctggggtgcagtggcgcgatctcagctcactgcaatctccgcctcccaggctcaagtgatcctcctacctcagcctcctaagtagctgggattacaggtgtgcaccaccacacctggctaatttttctatttttacaaattagacggggtttcaccacattagccaagctggtctcgaactcctgacctcaagtgatcccacagcctcagcctcccaaagtgctgggattacaggtgtgagccaccatgcccaaccttatttacttaatactttggatcctgttgcccagtattcctctccacctcaaggctggctattatcctagatgattttcacacccaagaggaagaactaacccatgttctggcttagcagtcatccaacaacatcctcctcctcctcctcaaccaccctcctgtggttgccttttggaccttcttctcctcggaagtgttcaaactcattctcccaagctctagtactacatagctaactgtttgcttgatacctcatagtcaacacgtcaaaatcaaatttacttttcatgattctcactctacctctcaacctcttaatttcactgttttttttttgttttgttttttgagatggagtttcactcctgttgcccaggctggagtgcagtggcgcactctcggctcactgcaacctccacctcctggattcaagcgattctgctgcctcagcctccagagtagctgggattacaggaatgcaccactatgcccagctaattttgtattttcagtagagatggggtttctccatgttggtcagactggtctcgaactctcgacctcaggtaatccacctgcctcagcctcccaaagtgctgggattacaggtgtgagccaccacgaccaccaatttagctctttttactccttcccttcctctcctactattttccctatctttgttaatggcagcacgagtgaatgagagccaacattcaaactgctaagtcagaaatctgggagtcatcctcagcaccctttccctccaacctaactcccacttccaagcagccacctcctaaatctctcttcagtctttctagttttctctgtccttacagccatcaacccaacttcagccactactctctcttatctagaccactgttggcagccttttaactgggtttcctgcctctaatcccactctacagcaagccccaatgtagctagagtttagtcacatcacttatcctgttgactggactttactggccttctttgaccttaggataaagctccattccttaccagggcttattaggccatttcatgacctttccatctatcacctctttagcttcagaacttgctgatccaccctagagttgtgtacttcagctagacaccttgagttccttgaatatggcatgaaggcttctcgcctgtaggccttttccacgcgcagttctttctatgcggaatactatcttcacccccactaacttctacttttagatctccttcaacagctctctaggaaagccttttcaatgtgcactttctccttttccccccatacacttaggtcaggtgttcctcttctgcactcccaaagtaccttgtgcttcagttatcatagaaaaatatcacactctgtctgtatccccacttccagaaactgtaaattctttaaggacggggaagttcaatttaatattccttggacctagtactattgacaattaaagttacttaataaatactacctgtactaagaatagatgggaggaaggaagaaatgctactggaatctggtaacaatgggccagggatcaaaatattcataacctgagtgcttatgagtaactagatgttagaagttactacctatttgaagtaattaacactaagatgtgattagagcttaatcctgccagaggccagtagttttccaaattgctaactggactgacaaagacgtgtatgagtatattacaagactgtacagtgacaaaagcaaaatttatgcatgactggaatttctgctccatccctacaagctgtgtaaccctgggcatgttacttagcctctatgtctccattctcaaagattgggataacactgacctcacagagctgtttatgaagattaaagggcaataacatacatcaagtgccagacaataaatgctagtttccttccgtgttctacttcccttttcccaataagacagttttgccccagcaaacctcgactctctcatttggccagaggagtcctggggcagggtctcctatggcaaagccacactctaggagcagcttccctgaagggtttttcatgagcctcttataggagactgaaggcttcactactgtgagatgccattctgtatatgaacaggctgacacttcaaaatacaagagggacatggccttagaactctgaatctcccccaacctaggactgcagctccaggcaaaacaacaaagccactaatgtggaatcctagttacaacaaggacaaggttgaacaaacagtaagtagttaaacttttcatgcataacagtgtacctagtaaggcatctctcttaccccctcaatcccaagagctttacaaaagaaggggaaggctgcttaatgacagctgacaaacacccatacgtcctgtatttttgagtatacgcttccacagaaaggagctctacaccacacccaagcctaaccagcctcaagatgtggacacaacaatagcatacagcagttggctggggatcagggctgagtgtgtggccaggaagcttaagcaaatgccacagcttgaaacaggaacaaaggacaagaagagagaagactcaagttcctgacccaataatgggttttattcattacagccaggaatacagaagaaaatataatccatttctgtattacaatggactgtaaacatgtaaaccttgagacagctcacaccacagaaaactcttcacacatacacctctctgacccctacagacccaacctcctttcttcagctgactttgttgtcagtggctccaaaaaggtcatggaacctcttgaggatgatgcaaattgactctattttatcacttattttcaggaccagtagaagaaatttaggaaactgcagaaacataagagtgatccctttcttttgtttttgtttctaggtttttgtttgtttgtttgtttgtttgagacaaggtctggctctgttgtccaggctggagtgcaatgacacgatctcagctaactgcaacctccacctcctgagctcaagccatcctcccacctcagcctctggagtagctgggactataggcatgagacaccatgcccagctttatttcttaaaagaagtactggtaaggctgtaaaactcctttccctctatataacaacaggaaagggattgaggcttatgccttgaacaggctaagaaacagacaacatgccctagcatgagacggttaaaaacaaacaacaacaaaacgacaaggtatccattgtcaaaaaccttccaatgctatgcttctcgctcctgtttggaggtaaggaactggggtagaaggaaatggaaggaaaggcatctctggggcttggacttttaatttttattgttttatttttaaaatcaccaagttcttcccactattataccctcccttaaagactgaaaaaacattcataactattttcttgttatcctcggaaatgtctggaaggcaggcagagttaaaaaaaaaaaaaaaaaaaaggaagtagcagcaacagcttggaaattaggcaattagtctgaaggcacagagttaaggggttaataaacactttctcagctgactcctgaatgaatcatgttccacatcctgagtcctccaatgtatactgtgttcaaacagaatatccaaagcaggggaacacctacagctcacagaaataaaactcaaatttttcataaaccaggcccaggctacccacatacaccttgatcaagtttagcttcttggactcagtactatacagggatactagaaaagtatcatgctttaggtaataaatggtggctcacacctgtaatctcagcactcggggaggccgagacaagaggatcgcttgaagccaggggttcaagaccagcctgggcaacacagtaagacccccatctctacaaaatgcaaaaaataaaaaaattagctgggtgcggtggcatgcgtctgtagtcctagctactcatcagtgaggcgggaagactgcttgagtcctggagttcgaggttgctgtaagccgtgatcacaccactgcactccagtctgaatgacagagaaagacctgtttcttaaaaaaaaaaagaaagaaaagaaaagaaaaaaacagggctgtgagaagagaggctggtggaagactgcaggccaagctaatctaggccctgggattcaaaatgaaatatgacacttattttgcccttcaactaaaaactgtgcttctgccatcaccttctttctaaagacaatttattcatcactgtatttctcctatgtatccctcgttctccagaaaccccttcatgagaaaaagtaattctactacaaaaccttcttcccgtgttgttttcttcctctttgcttttaaaacaataaacttagtggcaatcatctttggcaggaatatgccttgtctttgccgtgggaaaggttaaagtatagttagccgctagcccaattaaagtggagagaactaatcggccttattctttctccccagcccagctgcttgaccttatctgtttccctcctagatgcaatcccaatgcatctctcactgcatgctgagttaagagcagcacgagttgggatcacacaataagcagcatagtgtgattatcctttgcctggaatcacacacttacactccaaattggtaacctgaaaggaaaggtaatcctcaatgaaaacctgcaaatcatatctttttgatgatcttctcagacctgtaatcccaacactttgggtggctgaagcaggcagagtggttgagcccaggggttcgagaccagctggggcaacatggtggtactccatctctacaaaaattagctatgcacctgtagtcccagctactcaagaggctgagatgggaggacagcttgagcctcggaggtcgaggctgcagtgggctgtgtttgtgccactgcactccagactgggtgacaaaataagaccctgtctctaaaagaaaaaaaaaaaaaaaaaaaaaagaaaacaaaacccaaacccataaagccttcttacaaatgtttacacaaagtagctctttaacgttaatatattttacaaataattactacatatctacaacgttccagatacagaagaaatggccaaagaaggtattttaggagatccagattataatgaactatgccatttattaatttagtcacttctttaatatctgaggatgagcaaatcaaatactgataatggctgcagaaggacacaggctcttatataataatcttacttccattccagaataaaagggctggagaaggggggcaggattattctgttgaaggacaatggcatcctcagcaactcacagggatgtgcaggtgaacatcagaccaggatgggaaccttataatatctatgatatactatggcttctatcaaccagtttcaggaaaagcaaagaagaatgcagtcatggccaggtgcagtggctcacacctgtaatcttgaggtgggcagatcacatgaggccaggagttcgagaccagtctggccaacgtggtgaaaccccatcgctactaaaccccgtctctactaaaaaataaaaaattagccaggcatggtggtgggtgcctgaattcccagctacttgggaggctgaggcaggataatcacttgaacccaggaggtggaggttgcagtgagtcaaaatcacaccactgcattccagcctgggcaacagagcaagactccatctcaaaaaaaaaaaaaaaatgcagtctaatggcagaattagacttagccactttacttggaaaaatttggactttatcagctccatcaagcaccatgctccacaccatgcttattaaatgtctggagcaacattagatgggtgccattccaaattccaaataatcacatctttgctttgcaaacaggatgtggcttaataatcaaacagggaactagattcattcaagtatctagttcctaaaataagtctatttaacaggttcaacaacatgcaacacacaccctccaattggtagaaacacctctcaatgacaaagaaaggtggcaaatactaaacaccttcacagaccatttagcaactggtgggactaacccttgaaggtgaattcaaaatagaactgaacctcaataccagacttctttttcagaaaagggagtatgaattcttagtttcaggttcagacaaaaaccagaagttgtattgcattaggaaaaacactgggctggtcaggtggctcattccaccctgtaatcccaggactttggtaggccaaagcagggggatcacttgagctcaggaattggagaccagcttgggcaacatggcgaaaccccatctacagaaaatacaaaaattagccaggtgtggtggcatgctcctgtggtcccagctactcaggaggctgaggtgggagaattgcttgagaccgggaggcagaggttgcagtgagccaagattgtgccactgaactccagcctaggtgactaagcaagattctgtctcaaaaaaacaaaaacaaacaaacaaacaaaacctactggcccagagcctacaaataagttgtttggaggaagaggatggaaatctgttagttaagatttaacctgcatatgttgccttctttactaaaatcagactcataaagaaatgtattctggcttcagccttgttggtattgctctacctctatttgtttcccatgctattgcttcatccttgtttctgcagaactaggattttagctcaaagtcacctaaaagcctccacaggaaactacattccaaagggaagactccatgggaagagcaatagagaaagaagttacttttaagtctttggtaatgttcacccaacccagttttcattttctctcaatggacaagaaccctcaactaataaagctaatgaacttacaggaaggtaatatatggaaataaacatcttattgaatttatctggctctaaatctcttttgttagggaatttatagtattccattatcttacaatctctccatttctatctacttgattaaactatggtgctatagcaatggaggtgaaggcctaatttagaagtataggaattaggtatggcgcggtggctcatgcctgtaatctcagcactttgggaggctgaggtgggtggatcacttgaggccaggagtttgagaccagcctggccaacatggtgaaaccccatctctactaaaaatacaaaaattagctgggcgtggtggcaagcacgtgtagtcccacctactcgggaggctgaggcaggagaatcgcttgaacccaggaggcggaggctgcagtgagccaagatcgtatcactgcactcagcctcagtgtaggctgagtgataaagcgagactccgtctcaaaaaaaaaaaaaaaaaggaaaggaattattctcatgtatacaatagtaggaaacaacctataaagcttttgagaatcttataattcactgtgtacctccctctgtttcatattttcgcaattgaactatagagcctaggcctaggtcttaagacttttcttgtaaccttcagagtgcccagcactgggattgacatataccagttagacggatttttttttccataaaccaggctcaaactcttctaaaccaaaatcaacatattctgagtgccaatcttgggtaaggcactctattatttgtcatgaaggattcagaggaaaatgtgatctaccacactcaacagcaggcctcttatcctctccagcttaatgcattttaccagttaaggactaccctgatgctgagattgtgtttctttccccaaatcaaatgtcactctctaagggtcatctgtataattaaatgcttttaattctatatatcaaatgataacttttgtgaaagtaatttaaacacacttgaaacatcatataaaatattactacaagacttaaccgtaaatgtggctcccacccccataacatctatacaatataaccaaagagctagattccagattatcaagaaacttctaaattttgaacccatgcagcagaattgtattcctttacattgttggctcgacttacaaatgtgctgtggaataattatcctcaaatacaattttcagtactgattacatagctgcctaaaagaaaactgttagccccttccattttatgtgaaaccaatgtctaaagcgctcttgactcttcaaccccacattttccccaccctcatccctcctcaatccccagcccccactcatcacatccactagacctgaactttgaactcaatcataattctttgtgcctctgctcaagcccttcttcctgcctggaataccctcttttcagtcccggctaattacatctaccatcccattccaagtggccgctggaaactcacttccttatgttctatgatttctttcacaatttacactttttttgttttgttttgttttgtttgggggggggggttgtttttctgagagggagtcttgctctgttgcccaggctggagtgcagtggcgcgatctcagctcaccacaacctccacctcatgggttcaaccgattctcctgcctcagcatcccgagtagctgggactacaggcgcgcgccgccacgcctggctaattttttgtgtttttggtagagacggggtttcactatgttggccgggctggtctcgaactcctgacctcgtgatccgcccgccaaacattctatgtgccagaaacttgtatgtaactttgcatagttcttgtattatgtctccccaattttgagtgttttctctggtctctactcagcccttgctcacagtctcactaggaccctggctagcttgaacacggtcagaaggatcaccttagatttctgctggcacagtattttccataaattaatctcctgattgaaccgtagtcctatagtagttatctttggatgaaaacctaatgcagctcgaggaggaagtggagtgcctgtgatcagagggctggacaaaagcccatagggcgtctctggagccctgggggaactgtccccaggcaggcactctcagggcccaggaacagggcgggacaagtccgactcacctgtgaggtaaggacggggccaagacccggaaccgaaaagcaggtcacgatagcgctggaaggcctcgtcgaggactgagcagccgggctgcgcggccgagctgacatcgtactggaattgaaagttgttcgggtaaaggacgtagcgctggtcggaggtttggaagttctgaggccagggccagagggccgtcgcccgtcctgcgaacgctgccgccagcagcagcgaaaaccaaagcctggagcttgtcatggcccgctggtctcccctctcggagggggctggccacgtgagaccctggtcaggtgagcggcgcccccgtgacttatcggcgaatcacgtgaccagaggcggctctgcgcctgcgaccccaggaggacccacaccctgccctttcacttccggcctggacctgaggctcctgctacgtgcagcggattgtgccgggcgtcggcaactgctcggctcgccagactgttcacgggcccagtagagcagtaaataaccggccacccctgcggccgtgccggccgtgatggaactagacagctcacccgactcgagaagaacggggtggggaggcgaggacgcagggcgacctggagaagaaagtttcccagatggctctagggtgaatcttgaatgttgtgatgcagctcgccaggcctacggggaggtaaaggacttgccaggctgaagtaacttcagaagcagaaaaacggaggattaaaaccacaagtcgttgtgatgtgaaatttcgtggggcaagaaagggccggaagtaggtagtctgcacggctctgctagagagaggatcacaagatcacacaaatgtgatctacttatgactggaaaaaatgtgtactttcagagccagcttgaggcattccattgcctccaatatgagctcttcccttcaagattgactataaatctcttagttacaactcacatcccctttccccagacaaaaccccacatagcccggtgtgtatttactgaaagcagtaagatattgctggggctttgggtgcaagatggagagtgctcagagataatgacaggggcctggtcctgcagggccttacgtagaaagtcaaggaatttattctctgagcaattgaaaatcatcccgaaagatctgcattttagaaataccatgttgagtagttgcataagaaaccagttaggaggcccctttttattggaggtagagaataatgagagactgaactacagaagtggggaaggaagacagctgtagatccaagaaatagtatccggaagagaggcttgagaagtgatcaaggagaattccacagttatcagagaccctgtcttccttgttcaccactatattaccagaacataatacaaataatgctattgttattgggtggcattatttggttagtaggtactttttaaaatttttaaatttaattttagtattaaaatacatgtaaagatcaggaaaatgaacttttaaaaataaagggctttcactgggcatgataacacatccctgtagtcccagctactcccagctattcaggaggctgaggcggcaggatcacttgaaccaaggagttcaagtttagcctgggcagtatagtgaaaccctttctcaaaaacaaataaagggctactgaaataatgataatttatattcaggtcgtaggtacctaattactagttacacatacatggctttgatgggaaatcaaagaaacattctgacaatacagagattcatcaagcaatttgtctttgaaagttgattattcaaaaacagagcttgtagcaaaagaagcagaaattagatcccacagtcatcaagtttcagatcctaaggcttgcattcttacaccaatttcttctttgcttaaatcttaattttcatcagcattaattaagtgtctgggtactctgccagtcaggagagatgttaccaaaggtacaggatttgagaagtattgtcagaagagccaagttcataatcaggcccacaggatcaataatttgggggagtgtttagagcagtttcaaagatgagagcagtagatcaaagtagaatttcaggactgagcacatgccaaggcacccttttatggatattcaacctgtaccagaagggaggagtcatttacttaaaagagttacacaagatgaaagagctagatccaaataaagacgctataaaaattactaatggggctgagcatggtggattacagggattcagttatttaattattactgaaagagctcttttagacttaaccagatttttaaaccaaatattcttatgcatacataaaagtaagttacacaagataaatttgttgatcttccaaaatatccccccttactatacactagagtggggttttggcataatggcagacaaatagatggaacggaatagagggtccaggaaaagagccatttgattattactccatttcaatgaagacaccaatttaatttagtggggaaggcaagttattttcaataaaaggtgatgaagaaaatagatatccctatgtgggaaaaatgaactatgatcccctacctcacagcatacacaaacttaattaaaaatggatcacaggctggggatggtggctcacacctgcaattccagcactgtggaaggccaagatgggaggatcacttgagcccaggagttcaagatcagcatgggtaatacgaggaaatcccatctctctttatttttttcttttttgagatgggggtggttaatgggtacaaaaaaagtagcctgaataagacatactattcgagagcacaatagggtgactatagtcaataataattgtatattttaaaagagtgtaactggattgtttataactcaaaggataaatgattgagggtatggataaccccattctccatgatgtgcttatttcacattggatgcctatatcaaaacatctcaggtaccccataaatatatacacctactatataccaaaaaaacttaaaattaaaattagactgggtatggtagctcatgccttaatcccagcactttgggaggctgaggcgggtgaatcacttcaggtcaggagtttgagatcagcctggccaacacggtgaaaccccatctctactaaaaatacaaaaattagtgtggtggcaggcacctgtaatcccagctacttgggaggctgaggcaggagggtcacttgaacctgggaggcagaggttgcagtgagccaagatcacgctactgcacttcagcctgggtggaggttctgtctcaaaaaaaattaaatttaaatttaaaaatgaataaacagtttttaacaatatgaattatttaaattagtatatatacaacattgccatcaatttggacagtagatgaatataaaaaataataacatactgtatataatatttgatggtttttcttttttttctagttgtcaaatgatcctttattgaaatattttcctttgtgcttaactagctgggcattccacagcaccactgttgatgtcatctatgatgtcatgagggtgctggccatcaacattacagcccacagactgggcagtccccaggatctctttaatggttccagagagttctctggctaaggatcagtgccgcatctgttgagcaatgttgacgatctcatcaaaagtgatattcccactgtgtttaatgtttttctgtttctttctctctcggtggttctttgagggctttgatgatcagagcagaggcagaaggcaccacctcaatctgggcctgtctgttctgagtggttagtttcactgtaatcctcaggcccttccagtcacccgttgccttggcaatgtcatcaccaaccttttttggagacagacccagggggccgatcttgggggccagggcagaagtggcaccgacttcacctccagtgcacctcaggtatacaactttgatctcgttggggtcaaactttggcggcatggtggaggcagctggtgtcgaatgaacccggattcgggatgaccgaagaaagttgcaccttggcctcctccgagccaaaagctgagagctattttttctttattaaaggcagcttgttaaatgaataaaaacatgatttaattttcatatctatagcttctaataaaattaatttacatatcagaaaaataattcactgtcagacaatgtgttcaggtttttggctcataaattaagggatcagaaagaagcaggaaataaataatttgcctcaggaagtcttttacaatggaggtgaactttgaattgactcccaaagcatgagttagccaggcagggaaggggagcataggcaaagcacagagatgtgaaagagatgacatattgaacaaagggtttatggggctagcaaaagaaaatgtgccacgattacctcacttcctggtcctctaccatactctcttctctctgcaatgcctttcccactttccaatccctccacctacttgaaggtctaaacttatattttaccatcctggaaatttctgacttctcaaatctgggtaagatccccctctgtgatctcataactctctgagttaatctcatgtatctgaaagtacagttgacccttgaacaacgtgggtttgaactgcactagtccatctatacacagatattatgcagccaaaggcagatggaaaacacagtgttcttgggatgcaaaccccatggatatggaggaccatatgcaggacttgagtatgtgcggagtatatgcagattttggtatccttggaaggttggggacgtgggggaggcggttcctggaaccaatcccttgagtataccagggtatggctctattgttattgtttgtccatttgtctgtctgttccactacagtaagagcttcttaagggcaggttctgtgttcactagcccctggaacagtgtctagcacacagtaaatgctctttagcatgactttattcattttaagagtatttcttggccaggcacggtggttcacgcctgcaatcccagcaggttagggtctgaaactcgtgggctcaagtgactctcccacctcagtttctcaaagtgttgggattacaggcatgagccactgcgcctggcctagtatttcttgaatctcctactggtgtgctgagacagccagcccctcaatccttggggtggtagggcctggggcagctagacatcctggcgagtcacctgcagtcaagagcagtctcttcctgtgtgtgctgtgatgtgtggaaggggaaacatcatctcctcttgggtacttttgtatagtaccctcattatagcctctttacttgtccatgtcctccacagcccacatgctgaatgaatggtacctttttcacaattgtatccttactgcctaagccaggactctgcacacagtaagtgttcagcaagtacttgttgaatgaatgcatgaaagaggaagcatttgtgttaaattttgaaagagtttgaatttcaatgtgtaaaggaaaagagcagtctatagagggggaccacaatctagaaggataactctatgtaacttgttcactttaggatctccaggttctggaagagtgcctggcacatagcagacacttaatgaatattttctggatgcatacaatgaaatggcaaatgaacctaggcagagatctccaaagcatctggagagataccagggaagtaagcaattctgtctggctagaacaaacagtgcatgaagagaaatactaacagaaggaatgtaaggaatgttagaaagtaggttgaggccaggcgctgtggctcacacctgtaatcccagcactttgggaggctgaggcgggtggatcacgaggtcaggagatcgaaaccatcctggctaacatggtgaaaccccgtctctactaaaaatacaaaaaattagccggccatggtggcgggcgcctgtagtcccagcttttcgggaggctgaggcaggagaatgacgtgaacccgggaggcagaggttgcagtgagccgagatcgtgccactgcactccagcctgcactacagagcaagactccatctcaaaaaaaaaaaaaaaaaaaaaaaaaagaaagtaggttgaaactggattgtaaagtaaggaaagtaggaaattgagtgaggcaccagacatatgttgtcttatttatctctcacaacagctgtgtgaaaatgagtcttagctacattgtacaggtgaggtaattgactctgagaattaaaataacctgacccaagtcccatgtaattgtcagaaccaatgtttggacccaggtcttctgtcccaaagttcatttctttttatatctatcacagttccttgaaagctaggctgcagattgtattgagattttactcttgagtccatgggaagcgagagaaacttctttagttgaggaacaacaaggtcagagctaagattcactaagattaatctgttaacgtatgtaggagagattgaatgggaaagccaagtgcagggagattatctctgagactgttaactaagagtttaacctgaccatcctcatgtgctatgggactcagaaagtgtagactcaaattcacttgggactgatggtttcatttctcttctcccacactaggtggccagaccagcaagacttaagctttgtttaacttgtcaatgtttacagaagtgcaggttgccaaaattctctctgcaccctgactcccactcccttttttaattttttattttattttttgaaatggagtcttgctctgttgcccaggccggagtgcagtggctcaatcagctcactgcaaccgccgcttcctgggttcaagtgattctcctgccacagcatcctgcatagctgggattacaggcgcccaccaccacccacggctaatttttgcatttttagtagagacagggttttgccatgttggccaggctggtctcaaactcctgacctcaagtaatccacccacctcagcctcccaaagtatgaggattacagacatgagccactgcgcccggccacctttattttttattaaaaaagtttttttagagacagaatctccctctgttgcccaggctggtgttcagtggtgcagtggcacaatcagctcactgcaatctcaaactcctgggctcaagggatcctcccacatcagcctcccaagtagctgggactacaggcacatgctaccacaccaggctaatttttaaagtttttgtagagatggggtctccctatgttgcccaggctggtctcaaactccggggctcaagcgatcctcctgcctcaggcttccaaagtgctgcgattataggtgtgcgccactggcccagccatcctgacactctttaaatccattccatttcacatgcctctgcttctcctttttcctgttgcctccaagctcttcccttcctatttctagatttacaaaactctatccaatttatcactactgaacatatacaattttctgtagggtttctaaaaatgtgtccagggcccagtgtggtggctcatgcctgtaatcccagcactttgggaggctgaggcaggaggattacttgagcccagcagttcgagaccagcctgagcaacacagggagagcccatctctacctctaccaaaaagaaaatgttgtgtccagtttcccttcttttttagcccaatcccctcctgtcttctagttttataattatcctagttatcttattcaggtttactcactaagtcttagcagactttcctaaatctagacatacaccccttacaataactggctttgtcctatatccatccgatccgaggctataaatagacctttcttttcttttcttgtctgtagagacttgctgtactttttaaggatcttgctctgttgccctggctggtcttgaactcctaacctcaagcaatcctccctcttaggcctcccaaagtgctggaatgacagttgtgagccaccacacccagccagactttcatttatggcctgaattttttacaaaggtttttctgtgtgtcataaaactagaaaaactagagccccaagggaactttcaacagatctgagctaaaggagtgacagtggaaaggaggctgtgggacaaatgcatgtgggacaaatgcaataatatttcagatatggaataatggaactcagcagctaactgggtgctgtgggaatggggacaaaggaaaggggagaggaaaagatgtgagggtgtaccagcttggaaaggaaaagagcatgactttagtcattcgtttaaggattatttcttttttctttcccttctttctctcttttttttttttttgagacaggatctctgttgccctgactggagtgcagtggcaccatcacagctcactacatttccccacggaatgatggtgtactggctcagtacaaatggaagagcagatattgggaaaagaggatgagctctgagacatgctttttgagggatttttttttggagacggagtcttgctctgtcgcccaacctggagtacagtggcacaaccttggctcactgcaacctccacctctcaggttcaagcgattctcctgtctcagcctcccaagtagctgagattacaggtgcacgccaccacgcctggctaatttttgtatttttagcagagacggggtttcaccacgttggccgagctggtcttgaactcctgacctcaggtgatccacccacctcggcctcccaagatgctgggattacaggcgtgagccactgcacctggcctgttttgagggattttaacagacaattaggatgtccagcagagctgagattggtggctcaccagagagctttaagagtcacctgcccagagataacagttgaaatcatgaaaatgtatgatatagtcaagggaaaatgggaaaagggaaagttagctaaaaattagaggtaaagatgagagaggtttgtgagagacaagagaacaggggagagatggtggctagtagagtagactcagatcagaggtggtgttgatgaagggaaaggcaagaaaggaccttttcaaggtctcctcaacatcaggaggacattcagcctctacatcaggggtccccagcccccgggccatggactggtactggtctgtggtctattaggaaccgggcctcacagcaggaggtgatcagaggaccagcgggaattactgcctgagctccacctcctgtcagatcagcagcagcattagattgtcattggagtgggaatcctattgtgaactgcatatgtgagggatctaggttgcacactccttatgagaatctaatgcctgatgatcttaggtggaacagtttcatcccgaaaccatcccaactcattctccccctccccaccccccacccattccatgaaaaactgtcttccacaaaaccagttcctggtaccaagaaggttggggaccgctgctctacactactgtcggagttttatttatctaaattgtatttctgatcaagtcatcttccttctccagaacttttaatggctatggaatgctatcaggatgaaatccactgttatgatcagagccttttgcttgcaaggaatagagacttacgttatttcgggaaaacagaagtctatgaaagggatatacagagcaaacccagaaaagcacaaaaccaaatttcaaaaagagcagaagtcaagggcctggctactctctcatctccctctctctctcagtgttcttctattcctctcagaacgtccgatcagttttcctctttgcttgtcagctacttcaactgccttataacctctatttcctcctgactggagtgttgcacaagacatgtaatggccacctcagccctattccatctaatgttccagctccagggccctctcattctcccatctatgccagtggtgatcctactgtcctccaaagctctgtgcaaatcaagattgttctgattcccccagtcagagttaatccctccattgtaattccatagtctgggttccacaagtacagctcttaccacagccaaactcgtgttgtgattaattatgcatgttcagcactcccatgtatctaggaaggcacatgccatatcttagctctttttttttttttttttttgagatgaagtcttgctctgtcacccaggctggagtgcaatggcaccatatcggcttactgcaacctccacctcctgggttcaagcgattctcctgcctcagcctcctgagtagctcggattacaggcacccgctactacaccaggctaagttttgtatttttagtagagacagggtttcaccatgttagtcaggctggcctcgaactcctgacctcaggtgatccacctgcctcggcctcccaaagtgctgggattataggcatgagccactgtgcctggccataccttagctcttttaactggctttatcataccactgtaatggtatacacacacacatatatgtgtgtgtatgtatatatatatatatatatatgcagtatgtatgctaattataagctattcctatgaatttacatatcagatcccttaaaaggctgttttttaatctgtgtgatgatggtgttgattaaaacatatataaaatttcttccagatccatgattttattttgttagaaaaaattaacacaccttcagcagtcacattttaaaataacatttaaactattattttttctatagtgtactaggctgagagccttagagatctatagatataaaatgaaatagcaactgtccttcattctgtcttcaagatatttttcccccaatgaaactttagggatatttgtatccatatctccattgcaggccagtagaataagaagaacaaaactaatgacttgcatgcaactcctaacacttgagggttttagaccttttacaaataagggacaacaggattggacccattttagggacacaaagttacactcaagatagaaaatgactcaagatataccttggaaaccttgctagtgctaggccacacagggtgatgccctcagcaactttttttttttttttttgaggcagagtcttactctgttgcccaggctggagtgcagtggcacaatcttggctcactgcaacctccacctcctggactcaagcaatcctgccatctcaccctgccggtagctgggactataggtgtgcaccaccatacccagctaatttttgtatttttaatagagacagtctttcactatgttggccaggctggtctcaaacgcctggcctcaagtgatctgcctaccttgacctcctaaagcactaggattacagacatgagtcactgcaactggctgtcctcagcatctttatgaaaatgcattgagtaggcatcagttgggcacagtgctgagaaaggcactaacaataaaaataaggaattaaaagatttctctctggcgttataaagaaggaaatgctattaaaagaaggaaaatatgtgatgtgtgttttcatctgtattagcatagactatgtctcaaagcacatatatgcaaccggtgcctctggagagggatattgggtgggtaaagcataagatggcagggggacttcctgtatatccttttgtgtgtttcatattttgtactatgtaaatatgttccacctataacattttttagttttttaaaaaagtctatgtcatttcctttaattctcacaataatgcctcgaggaatgtattgttaatatcccctttaccatggcagctgtttgattagggctcttcccactttaagcttatatcaaggttggctaaactcatggaaaaacatcagaagtcccatccagggttagaccaagagtccagggccccgatattgggatttttagatcaaaattggacaaatttataggcatatgacagctctatggggtttaaggcccttttagtggggactccttctgcctagactatatcctcctgccccaggcatcctgagagctgcttcagactaggattatcttgagtctaacctggtcccttagacctcattcctagagaggtgatggtgatacattttatggcagggctgctcatgttgaccaaatccacaaaaataatctgaaatcccctgaagggaggtgggacaatgatgaaatggagtatataaatccttcacagaaagtgattcagatcttatgttattttgcactggaatttcccagtgggccttgctcactccttgccttcttcccattctcttcctgcttgagtcctctatatcttattttccttccttgactaatagccaggctacaccctccaggaaccccagagcacagatccctgtaacatttctgtcctttggccatccactaacatttggcttcataaaatgttagtgacatattactgtgatacaggtttccaaaacacacaattcactgatgctaggagtggactcttcagtggtaagagcacagtctaaatgtcttacctctgttggagtgccttttggatctttctcttagattcctttttttttttttttttttttttgagtcggagtcccactctgttgtccaggctagagtgcagtggcatgatcttgagtcactgcagcctccgcatcctgggttcaagtgattctcatgcctcagcctcccgagtagctggaattacaggcacacgccaccaagcctggctagtttttgtatttttagtagagatgggattttgccatgttgaccagactggtctcaaactcctgacctcaggtgagggaactgagaaccagtgaggtgaagtgctgttcctcaagagtaaggatagaatcctatttattgtggtacttccagcacctagcacagtgccaggtacctagtgggtgctcaataaatatttgtcaaatgaaaaaattttttccttgttgtacatagtatagtgctttgcatgccaatacatttttaaattgaaattatttgatccaggtcgaatgcagccaaagggtggcagggctggaaacagaccacagatgtgtggccatcctgacaagggctctcattaccacactggaactgtgcctctggaaatgcctacaatcatctagcccccttgagtttggagttttttgttggtttgttttgttttttttgatggagtcttgctctgtcgcccaggctggagtgcagtggtgtgatctcggctcactgcaatgctatgttgcccaggctgcagtgcagtggcacaatcatggctcactgcagcctcaacctcctggattcaagtgatcctcccatctcagcctcccaaatcactaggaccaaaggtgcacaccaccacacccagctaatttttttttaaatttttagtagaaatgaggtctcactatgttgcccaggctggcccccttgacattgaatgcagtttaatcatggagctttccgtgcctacatccttttcttagcccactgccttattccagaaaggaatgataattggatttgaaggtgcatggccaactttcaattaaccctagaactggaaagaagcagtgatgcgaataatctaagagtcactgtgtttggccagtggtgttcctccccggtagtagctgactgacttattttcctaaagaaagtttgcttaggggagtattaaaaatccattaaccttccttgagtttacattagccagacagtggcaggaggccaggggaaagataaagcattgttcagagccaataagtgaacatacaagtaactatgaagtgattatagctctaaccatgaagacaaaggtcaaagaaatagtgattcttcccattgtgataaacgatgttatgtaatataagaatgttccaaaaatgagaaagattctttgcattctaggtgcaaaagattaaatacttgatgttcttgtcagagatcttttagttgcaaggaagagaacgccaagtagctcaagagtgaggagtttatcatctttacaagcacctagaagtaaatttaactatagcaatggtcaaatgggctagaatgccttattaggaaccaaagctacctgttgatctctcaggacccacccttctctcaacccttttcctgcatctgcttcattctcctgttatttccaattcgttctcttagtgttccagtgttcccaaagagaaaatttggttggcccagctaggaagagatgtcattcttgagccaaacattaaagacgcatactgtaggctgggtgtggtgactcacgcctataatccgagcactttgggaggccgaggcaggtggatcacttgaggtcaggagtttgagaccagcctggccaacatggtgaaaccctgtctgtactaaaaaaaatacaaaaattagccaggtgtggtggtgtgtgcctgtagtcccagctactctggaggctgaggcaggagaattgcttgaaccgggaaggcagaggttgcagtgaccccagatcacaccactgcatttcagcctgggcaacagagcaaggctctgtctcaaaaaaaaaaaaaaaaagttaaagacacaaactacagataagaatggtagggtcatctaatccatagacgatcaaagctccgtctttgagcaggtgctagggaggggaacagattcacttagaaaaggatatgggacaggcaatgactgtcatttatttattgtaaaagcaacatgtatttattttgaaaaatttaaacaccacaatattgtgtgtagaaagtatgactctcagttcaccaactcagctatgtagaaattacaagtgttttctacaacaaattaatttctaacttcatgacccaagtccccaatctgctgggctacagggaaatgtcaccacagtccttcctgatgtttacgcatttcccagggcttatttcgcactcttgagccctttatggtgccaagaggccatatagaagcctgaaagataaagactaccatcactttagcacatatatctgtttatgtatgtatgacatagtatgcatggttctttcttttttttctttttttttttctttttgagatggagtcttgctctgtctcccaggcgcccatgcagtggcacaatctcagcttactgcaacctctgcctcctgggttcaagccgttctttgcctcagcctcccgaatagctgggattacaggcacccgccaccacgcttggctaatttttgtatttttagtagagatggggtttcaccatgttggccaagctggtcttgaactcctgatcttgtgatccacccaccttggccttccaaagtggtgggattacaggtgtgagccaccacgcctggctggttatttctatgtatgaccatcgttttcttttcttttcttcttttctttctttttatttgagacagggtcttgttctctcgcccaggctggagtgcagtggcgcaatcactgctcactgcagcctcgacatcccaggctcaagtgatcctcccacctcagcctcccaaatagctgagactatgcctggctaatttttgtatttttagcagagacagggtttcgccacgttgcacaggctggtcttgaacttccatgttcaagagatctgcttgccttggccccacaagctgttgggcttataggcatgagccatggcgcccagcatattttctctctttctttctgttttttttttttttttttttttttttgagatggagtttcgctcttgttgcccaggctggagtacaatggcacgatctcagctcactgcaagctccgcctcccgggttcaagtgattctcctgcctcagcctcccgagtagctgggattacaggcaagcgccaccacgcccagctaattttatatttttagtagagacggggtttctccatgttggtcaggctggtctcaaactcccgacctcaggtgatctgcccacctcggcctcccaaagtgctgggattacaagcatgagccaccgtgcccagcccagccccactattttctatatacacacatttataatccttcaaaacaaaaaatcagggcgtgatgtaaccactattttgtaaatttttcagttgataatatattaggggcgtcttttcatgtgcacctataaagagctaacagtctatttttatttcatttttattatttatctgtttgagacaggatctcactctgtcacccaggctggaatgtagtggcataaacacggctcattgaatcctcgacctccctggcccaagcaatcttcccacctcagtccccccagtagctgggacctcagacatgcgccaccacacctggctaactttttttttttttttttttttgtagagatggggtttcaccatgttgcccaggctggtcttgaacttctgggctcaagcgatttgcctccagcctcccaaagtgctggaattacaggggtgagccactgtgccaggactattttttattttaccaagtggagaaaaaactaacaagaataggaacaacctgaatattattgataattttaatgtgatagatttagaatcttatattctacacaaatatatttaaaactttatactttacacattgtttttatattttatttattttttattttttttacacattgtctttaaatgcctaaaggacgtttaggaaaactggctaaatgacaaatgttactaaattccaaaaggaaaagagttcttgtaggacatgttatttgaccataatatattaaaactaaaaaaaaaaatctaaacatgtggatatatttttaaaattctagattattcttggcttgagtatataaacaaatactcctagcagtatattaaagaataatgtactatgttcataaatacgttattagaggaatgtaaaattagataaatgttaagaaatgtatcaatgaaatttttacactaaatagattaaagaagaaaagccatattctagaggctaagagggaatttgatacagccattctaaattttaaaatcttgataaaatagaaatggaatggaacttctttaacacagaaatgaatacacaaatagacaaagaccaataaagccagttccattaaagtcaagagtaatataacgatgtccaccacccttaatacttcatgaggactattctaaagggtctaatcaatgcaatatgacttttttttttttttagatggaggcttgctctgttgcctaggctggaatgcagtggtgtggtcttggctcactacaacctctgccccccaggtgcaagcgtttctcctgcttcagcctcctgagtagctgggattgcaggtgcatgccaccacacccagctaatttttttttgtatttttagtagagacagggtttcaccatgttggccaggctggtctcgaatgcctgacctcaagtgatccacctgcctcggcctcccaaagtgttagattacaggcatgagccaccgtgcctggccagtgcaatatgacatattttgtaaagggagaaacagaatgatcatcatttgcagatgataggatgtttacctagaaaatctaagagaaattggccaatagaatgattagaatttaaataattcagtcaaatgatcagataaaaggtaaatacattgaaaaaataatttattcattagcaataacaaatcagaaaataaagtgaaaaaatgtgattcagaaagcaagtaggttaatgtatataaagcacctagcacagttcctggtagatgggaggttatagaaataagctgtaataatcttagttattgattttatagattttagggatgaaattactgagacaaaagatgcaaacatttttaagcttcttgattcatatattcaaattattctttttttttcttttttttttttttgagacagagtttcgcttttgttgcccaggctggagtgcgatggtgtgatctcagctcactgcaacctccacctcccaggatccagcaattctcctgcctcagcctcccaagtagctggagttacaggcacctgccaccatgcccagctaatttttatatttttagtagagatggggttttgccacgttgatcaggctgatctcaaactcctgacctcaagggatctgcccgccttggcctcccagagtgctgggattacaggtatgaaccaccacatgcggcctcttttaacttttagttgaagtataacatgcatatagatactttgggaggttgaggcaggcagatcacttgaggtcaggagttcaagcccagcctggtcaacagagtgaaatctcatctttgctaaaaatacaaaaattagccgggcatggtggcaggcacctgtagttccagctacttgggagactgaggcaggagaattgcttcaacctgggaggcagaggttgcagtgagccgagatcacaccacaactctccagcctaggtgacagagaaagactctgcctcaataaagaaaaaacaaaacaaaacaaaacaaaaaaacatgcatatagaaaaattgtgcatacagaaagctggtcatcagtgtacagatcgagaatgaaactttatagtactccaagagctcttcgcatgtctccttccaatacctagccatcttcctccccagagtgtttctgacttctaacaacacagattagttttgcctgttttgcacttcatatgaatagaatcatacatgtgtactcttttgtgtttggattcttttgctcagcattatatagaaaagattcatccctctttgctcaggtggttgtagattactcgtattgctgtatagtatttcattgtataactagactgcaatcttccattcttctgttgatgggcatttgggtagttttgaatttggggctattatggagtgctgctgtgagcatgctgatacatgtcctttgggggccatatggaacattttgaacccagcactgctatggtatcttgaagagcagtggcttttagcacattggcttatagtcttctgggctatagatactggcatattcatagtgggccctgtcagcagtggcagtggtatagcagcacccttaaatggcttcatgagtagaggacattgaaaagagggaaccagagccaaaaagggagaaaaagatggacgctgtatgaaggaccatgactgacagactggttcatgagcctattgagacaaacctggcatgaactccaggctactggctactgatagggatataattttaaattataaccacaaccaatagagttctagagacatctgagttgccccctttttaaatttttattttaagttcaggggtacatgtgcagatttgttatataggtaaacccatgtcatgggggtttgttgtacagatttcatcacccaggtattaagcctagtacttattcgttatttgtcctgactctctcccttctcccaccccccaccctccgataggccccagtgtctgttgttcccctctatgtgtccatgttcccactgataagtaggaacatgcagtatttggttttctgttcctgcattagtttgctaaggataatggcctccagctccacccatcttcctgcaaagcacatgatcttgttctttttatagctgcatagtattccatggtggatatgtgccacattttctttatccagtctacgattggtgggaatttatgttgattccatgtctttgctattgtgaatagtgcttcagtgaacatacatgtgcatgtgtctctatgatagaatgatttctatccctttgggcatatacccaaaaatgggattgctgggtcaaatggtagttctttctgtcttcatgtctttgaggaatcatcacactgctttccacaatgtttgaattaataatttacactcccatcaacagtgtatgtgttcctttttctccacaacctcgccacagtctgttatttttttgactttttatagtagccattctgactggtgtgagatggtatctcattgtggttttaatttctctaatgatctgcccctctttccacggtctccctctccctctccctctctttccacggtctccctctccctctccctctcccctctttccacggtctccctctccctctcccctctttccacggtctccctctccctctctttccacagtctccctctcatgccgagccgaagctggactgtgctgctgccatctcggctcactgcaacctccctgcctgattctcctgcctcagcctgccgagtgcctgcaattgcaggcgcgcgccgccacgcctgactggttttcgtatttttttggtggagacggggtttcgctgtgatggccgggctggtctccagctcctgaccgcgagtgatccgccagcctcggcctcccgaggtgccgggattgcagacggagtctcgttaactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtccgggatgtgaggagcccctctgcctggctgcccagtctggaaagtgaggagtgtctctgcccggccgccatcacacctaggaagtgaggagcgcctcttcccggccgctatcccatctaggaagtgaggagcgtctctgcccggccgcccatcgtctgagatgtggggagcgcctctgccctgctgccccgtctgggatgtgaggagcgcctcggcctggccgcgaccctgtctgggaggtgaggagcgtctctgcccagctgccctgtctgagaagtgaggagaccccccgcctggcaaccgccccgtctgagaagtgaggagcccctccgccctgctgccaccccgtctgggaagtgaggagcgtctccgcccagcagccaccctgtccgggagggaggtgggggtcagcccccgccaggccagccgccccgtccgggagggaggtggggggtcagccccccacccggccagccgccccgtccgggaggtgaggggcacctctgcccggccgcccctactgggaagtgaggagcccttctgcccggccagcagccccgtccgggagggaggtggggggtcagccccctgcccggccagccgccccgtccgggaggtgaggggcgcctctgcccggccgcccctactgggaagtgaggagcccctctgtccggccagccgccccgtccgggagggaggtggggggtcagccccccgcccggccagccgccccgtccgggaggtgaggggcgcctctgcctggccgcccctactgggaagtgaggagcccctctgcccggccaccaccccgtctgggaggtgtacccaacagctcattgagaacgggccatgatgacaatggcggttttgtggaatagaaaagggggaaaggtgagaaaaagaatgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagacgcttgaaggcagcatgttcgttaagagtcatcaccactccctaatctcaagtacccagggacacaaacactctgcctaggaaaaccagagacctttgttcacttgtttatctgctgaccttccctccactattgtcctatgaccctgccaaatccccctctgcgagaaacacccaagaatgatcaataaaaaaataaaaaaattaaaaaaaaaatacaaagattaatttctctaatgatctgaacatagaaaccagcaaagatttcatgatgaagatgcaaaaagcaattgcaacaaaagcaaaaattgacaaatgggatctaattaaactaaagagcttctgcatagcaaaagaaactatcaatagcgtacacagaaaacctacagaaagggaaaatttttttgcaaactatgcatctgacaaaggtctaatatccagcatctgtaaggaactcaaataaatttacaagaaaaagacaaataaccccattaaaaagtgggcaaagggcatgaacacttttcaaaagaagaaacacatgtggccaacaagcatatgagttcccctttttttatttgctatgagggaactgtgtcttatttatttttgtgtcccagaagctagcacaaagcctgacacacagccactgctaacaaaatgtttgtggatttatttaataaaagagttgggagtaggtggagaatggagggtggggagcatcacacatacatgcacatgcttaaaatgtggtgatttcttcctgatctgaccagatcaaaaatataaaacagaaacaggatctatgccatgggtcctggccctttttgcttctgccagcatgtgtgaggagatgcagagacaaattccgtggcagttagagaactaactgccaagatggagcgaagggaacatttaaccttgactttccacagtcctgaggttcccaaaataaaggggaaccggaaataccaaagggtgaggaggtatctaattgaaagtcagatgggaagaagagaacttacttaaaggcagggctacacagagcatcctaaagacagaaaagatcaccctgaaaattgtggggttttttttttttaggagtagggaaaaatatctataaatcaaacacacatgggaatgcttgaggtagagaagagcgggtgaccctggggatcaggggttattctttcgggtaggcaatatttccctcatccttgtagcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccaccctgtgagtgccaccgaattaaatgccacaggccccacacaattgcagagctttctgctcacacaaattggcccttcatgtttcttcctccaagatcttttggccttcacctctccaagtgcaggatggatctttctttggtatcctcagtgtgccctttctctctcctattccaggttgtttcctgtcctaaataatgggttatactctctttatgggaagaactgtttttgtttgttggttggtttttcgagacaggctcttgctctaacgcctagccgaagtgcaaaagcactatcattgctcactgcagcctccacctccaggactcaagcaatcttcctgttcaacctcctgagtaggtggaactacagatgtgtgccaacactcctggctaatttttaatttttttaaatttttttttcttttgtagagacaagttctcattatatttcccaggctggtctcaaagtcctggcctcaagtgatcctcccaaagtaccaggactataggtgtaagccaccatgcctgccctaggaataactcatttacaaggtgttactgctaagcaatgtgattggtattctaatgtggcttgcagaattagaagagaagtgattgatcatagctggaagataaagcaaatatcttaacctctattagatttaactttcaaggtcagcttgttcttctcctagcagtggaatagaacttaaatgtacgttagatatgtggtataacaaatgccagctatgaagataatgttatttatgtcaaattttatgtgaatttaaataaatctgaaagtgcaacacaaaatattttaaaataagtttttggggctaaaaataacatatgcatgaatttttcaatcaaaccaaaaacttagaggaaagatatcattacactgacagttttcccataacccgcaagatatacatttacacaaagaagtgggtattgtgaaagaaaacatatgtgagtaaagcatctattctcatcacataagcaggggtcccatctattctcctcacataagcaggaggggagcacctgtgcccaactctgaggtacagcatcagttgtttggccatgggctgtgacatttgatattaagggacagtatcctgcatgatcttgagaagaaactaaaatcaaaggcagacagacaattcaactgcataaaacgaaaactagagaaaatatttgcaacaattatgaaagataaaggttaatggccttaatatagtaaaaggatacacaaagtattacaaagacacaaactcaaataaataagttctttttgaacagacatgcacaaaagaagaactataactatctaataaacataggaaaaataatttaacctcaatcattaaagaaaggtaaatcaaatgaataacaagatgtaacttttcaaccaccatattaacagatttttaaatgataatgcaactgctatcactcccatacgcattcctgtacatgccatgcaaattggtataactaaagcaatatgattaggtgtatccagagacttaaaaatgttcatctcctttgagtaaataattccatttctagaaattaattccaaggaaataactagaaatggattaaaaggtttaggcaaaaagattaagctgcaatcatatttatgtaactgggtgcccaggctaaaatttcatccttaagattattatttaaatttttaataaattagggctgggtgtggtgactcacgcctgtaatcccagtgttaccagaaaggggtcctgatccagaccccaggagagggttcttggatcttgggcaagaaagaattcaagatgagtccatagagtaaagtgaaagcaaatttaagaaagtaaaggaataaaagaatggctactccataggaagaggagccccgagggctgctgtttgcccattttaatggctatttctttattatatgctaaacaaggggtgaattatattcataagtttttggggaaagaggtgggcaattcccggaactaagggtttctcccctttttagaccatatagggtaaattcctgacattgccatggcatttgttaactgtcatggcactggtgggagtgtcttttagtatgctaatgcattataattcatgtataatgagcagtgaggatgatcagaggtcacttttgttgccatcttggttttagcgggttttggctggcttctttaccacagcctgttttatcagcaaggtctttatgacctgtattttgtgctgacctcctatcattcagtgactaagaatgccttaacctcctgggaatgcagcccagtaggtttcagccttattttaaccagcccctattcaagatggagttgttctggttcaaacacctctgatatcagcactttggaaggctgaggtgggggatcacttgagcttaggagttcaagaccagcctgagcaacaaggtaaaaccctgtctctacaaaaaatacaaaaattagctgggcgtggtagtgggcacctgcaatcccagttacttgggaggccgaagtggagagttgcttgagcctgggatgcagaggttgttgtgagccgagattgagctactgtactctagcctgggtgacacagtgagaccctgtctcaaaaaagaaaaaaattaatacattagaatcccgaaattatgtcacttaaagcagtgaatagtttatttcttggagccctggattcacctttatgcagataaagaaaatcaaggaaatcaagccagcctgtcactcagattttgtggagtcactttgtcactcacctttgtttatgctttgttttatctctacagactgtaattatttagagaaagtcaactgaatccttaaggtgcataagtataaatcaagtatccaccctattttccatgttattataactagctctaattcaagagtcagtaattaatctgcaatacagatctcataagaaatatcccacaatgtaagcaaaatgtccaggcctcatctccctgtgacaatataatgttattattgcccgaatacattatttatttatttatttatctatttatttttgagatcgaatctcattctgtcacccaggctggagtgcagtggcgcgatcttggctcactgcaacctctccctcccgggttcaagcaattctcctgcctcagcctcccaagtagctgggattacaggtgtgcgccactgcacccagctaatttttgtgtttttagtagagatggggtttcaccatgttagccaggcaggtcttgaactcctgatctcaggtgatccgcctgcctcggcctcccaaagtgctcagattacaggcatgagccactgcacctggcctccgaatacattattgtctaataattactgtccaattcaatgacttcaaacttttacctactggattgcaagaatttcgttcccctccctgacagtttcctttcataagtcattttcgtaagtttcacaggggctatctcaggtgtgtttaagaatgtgcatgctcatattcctattccctgggctcacttcagggtgttgtgcttctgtctctgagttcacctgggtctagatgactgacagcctctctgttgtggctgttgctaatgggatgaagaagggatggggaggaaaggacagtattcttcacttttactaggaagtctcaagtgtagaacagacccttctgttattttcccatagcactggtgagatcaggctgaaatataaaggatatattgccacagagagtagtttgaactgttttgcagagcgtgggaaagaaagggtaagtctttttgtcaaggcactgggcaccctagagttaggaccctaggaacaaccatatagtacacattgccaagctgtgtagggatgctttattctggcactccaactgggttacgaggggacttaaatactaagcagatttcatagatacctcttcagggtcctaagtctccacccaggatcatttccattccaaaaccacccacttggggcacctcatctgagcctggagaagttgtatgttgccttccgtgccttgaaagcggtcacaatggcagcagcgtggaagttcagatttggctaaataagtgagctgattccccagcttgtctccagcaacaccactttccaaaagctccctggccaacttttacttccacaacagtagaaggagatcccgcccattatttacaaactgccaaatggtgaacgttctcatttcactgagatctgaggggatgccacagaacactactgctttctggttgggtgatgccccctccaatcttggtaggggttttacatctcacccaatggtactctgaagtgtagcatcgctgactgatgctgggctgatcccgagaacatctacgaaaatcttaccaagtttttcagatgatttgtacttcctcctcaaattgaaagtgacatcctttctcttcccaaggtattagtttcagtaagctgggagaagtgccttggtattcttgtaacttaagtctgcatcaaagtatatcagtaaggaaaacatcaaaaatgtttggatacagttgacccagacaggtgacacaggggtgttcgttttatctcaggcactcctttttccggaccaaggcttcttacagaaacatacaagcagagccttttgtgatttagatcctaagatttttgaaactttgatgagtaagctgttgtaaaaactgttgtttaaaagctgaaattagctttggtgttacaggagatagaagcttgaaatcagcttttggacatttatttatttagagtaatatgaattaaaaaactataaagttaaccaaatgcagatgtcttagactctgaatataagtgtgtagtttgtttatataatttgttgtatatgattattcctaatagacttggttactttgggaaggttagactcttctatgctgcacatctttaaattgttccttcagagttgtgaggatcttgtttatgtagttttcaggagatgagaaggtaacacagagagaattgtaagaaatatataaagttgcagtcttctcctcatggtagaagaggaactggactttatatgttaggctggagttggacaggaaatatcctcgacagtgctccttggtgttttgaatattaaaatcatttgaattagtgcaagctaaagagtgaacttatttataaagattcagaagaatctgccaggtgtggtggctcaagactgtaatcccagcactttgggagtctgaggtgggcagatcgcttgagctcaggagtttgagaccagcctgggcaacatggtgaaaccccacctccaccaaaaatacaaaaaattagccaggtgtggtagtgtgcacctgtggtcccagctactcaagaggctgaggtgggaggatagcttgagtctgggagttggaggctgcagtgagtagagatcatgctactgcactccagcctgggttacagactgagaccccgtctcaaagaaaaagataaagaaaaaaaaatgtggctcagaagaataacatagactcccaaggcaggaagttcgctggaccttaggggattccagaggaggctgggatctcagataaagaaaatcaagccagccagtcactcagattttctacagtcactttgtcattcagctttgtttatgttttgttttatctctacagctcagtttttcctgtttattagtgtgtaagtgcctaaaaggtgataccccggtcaaactttacatcttctcagttcaagcaagcaaaagaggaaatccaatttctaagcataagaataaaattgtcccaggatgggtcaggttcccatgcttagtccaggtagctatagtcagagggctatacagacaatagtcaagggctatagacaagggctgctagagctcatggaggattgtggactaaataccacaaaggctgcctgttaccctgggcttcatacagctcaatctgggcttatgttctggctggctacatatactgctaattctgcataacccagtcttcagaaaatgtgcagcttgtgaattactatgttttaatgtggctcacttgttagggctacagagcaacttaacatctgtggataggggtgtggtttctctgaatggaaattcctgcaattcatcatattagtaagtggcaggttctggagaacaaaatgaaacaaggaggcagatattagactggataagcttgatacataatttctgctctctgggttactcagaagctggacttggattcttaggcatataagtggttagagaactttctaaccactggggtgggggtgagctggtccctgctacactgggacagaaaaagaagctagataaggaggcaccttataagggatactgaagatattcctgggtgtctggtagctcagaaaagctatagctacttgtaattataagttatcttctaaatcttcagtaaaatattgatggggaagtcgaagaacctgttccatcttagggatgtggtagcaaaaagtaaggttgagcatatccccgctgctctcttaccaacatccagtccgcagtggcagagccaaagagaagacacctagagccaaagatggaagaaggagaggtgtggcacttggataagagcaacttgaacaaatatgagataggactttgggggactctcagaataaaaaaaaagtggagggaaacactttgtggtaagttcctgcagcttggtaaattggggcttgaaatcatcataatatggaattaaagtaaatgaggctgggcgaggtggctcacgcctttaatcccagcactttgagaggtcaaggcgggcagatcacctgaggtcaggagttcaagaccagcctggccaacatggtgaaaccctgtttctactaaaaaaaaacaaaaattagccaggcatggtggcatgtgcctgtaatctcagctactctgggtgacagaatgagactctgtctcaaaaaaataataataaaataaagaaatagataaataaagtaaatgtgacttcattttgtagtcataggctgacaaggcctgtacatgccagatagagctggaagtgaaaaaccaatggaactaaacaatgggtaagtcattaagcaaagtatattaatatgatagaatattttgtagccatcgaaaataatatttacaacagataatggggaaaatcacatcatatattcttaagaaaaaaacccacatgatatctagtatcatatctactatgtacagagggtagaaaaataaaatattaacaatggttgcctctaggtagtcaaattgtggctaatttttttcctgcttctttgttcttttgtagtcttttgaatacttatgttgaacgcgtattacttactacttttagaattagaattagaaacaagaaaaaggtttaatctgttttgtcattggtgacaccttttataagctagtttatatctaaatcaatgcatgcagaagtatttgtatattatctttagtttaacaatcatagtaaagaaattccaagcaaaaaggatgtcatgtagcaagctctgctccatcatcctttgttcttaaatccttctctaagactctatctggcctttttaagggaaggtccctcactggactaaccacggtcttcctttcctcttcttcatgcagattatctccaatattccagggccttctttctcatctctgtctttaccatacttactggccttggctggctcttcagctcttggatccttaatcgaggaagcatgaccaccaacttggatctgaaggtatccatgctcagcttcatctcaggtacagacctagactggcagggtattttaccatggtaaaatagtcaaggtaacaaattttctctgtggaactctcatactctttttcttatctctttgctcttcttcagtatcacaccaacttgccagctatctgccttatctaattatatagaacacaccttagctgactttaccagggtatagagcctttctctcatcttggtcagtccccaggtttttatctttttgatcctcgctatacatatggcctctggaggccaaagagctgggggtggcggggaagacagactgaagatgctgatgggttgtgacatctttccttctggtcctagctacctgcttgctcctctgcctcaacctgtttgtggcacaggttcactggcatactagggatgccatggagtcagatctcctatggacctattatcttaactggtgcagtgacatcttttacatgtttgctggtgagtcacttccctgctctatgctagaaggatggatagggaaatcgcttctggaaagggaggtataatccaggagaaatagaagcactgactgttccttttcagaacactgatacttggagagtcaggggggcataatgaagaaagggtggattttagagtctgaaaacctagcattagtaacctgctctatcacaaagtgaggcatggacaagttgagtaacttgcccaagaccacacagaaaatagtggaactatgatctgaatccaggaggttcaagctttgtcctaatcagtctgagaaatattataatgcaattagagcacaggagggtaaagtaactccactgggggagagaggggttcactgaaaagatgcctcttgaactggttattaaaggatgcataagaattttaaaagccaaaagaccattgcctattgaacctcacctcaaattattcccttcccgtagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtcttttgcgtgcattggatccaaaatatatatgatagtcataaagtaaataactcacttaagaaaaacatttctaaaagaaaacaacaatgtttagagtcatgaatgaaagaaactagtgaaagatgcagtgtgtagaccagagacctctttgggtatcagggatctcatggaccagaatggcccgtggagaagaatgttaattacttctgtttggaattttctttattatgtgtggctttgggtatactcaggatggaaagcacttggacaaatactgttgaatctgaacttaatagcattaccagaaatggaataaatatcaatggatataagacctactactcaaaggaactgagaggtgctgggtagattccagggaatccatggggtcccacttactgtgaggattggtaatttgaaacatttacagtctattacgtaaaaccactgcttctccctaggcagggagataccttaaccaggcatccacaaactccctgaaattctatacaaaacttgtatatgtattcttctgtgaagagagccagagattccatcagattcttccttccccccgccccgcccccagaagatagtttcatgtaaactccatcaaattcttgacaggctggtgaccgctttgattccttaagcatcaattatgttttactgagccaaatgggactacagggcttccttcagcagatggatagatagataaatagatagatagataatagattgatagatgatagatcgatagataggcctatctatctatatctataatacatctacatctatatctatacaaactgaaagattttccatgttttatatatcctgtaaagctaagtacggagggaggaggtggtattttcaggcaatcatataggtcttttgatggctaaagatccctttcacactcagactagatttcacacataaagttcctgatactcattttgtctttcatacccttagttgctgccactactgctgtattggttgagatccattcttctccccaaagctggcaatgaaatggactatagtgtccagcttcacctcttgctgcatgtaaagataagcccttgggtctatttggtttaatttagagattcactagtaacctttgcagaaaacccaaataatagacattgagcaattatataattcttgtaatcctggtcctgatcagtaattcccaaacatttccagatggtaactggaagccctttaagttaatacttatgcttttattcctgtgggttggagcttatacacagcacacacttgtatgcacccacacacagatacacaaacagacatatatacacacacctcattttgatcctgccttagaaaaccctttcttcacgcccctcttccaatcaggtgagtttcgttatggcagaattacttgtgcctccttgcttcaagtggccttagttcagaggctcttcaggctgtttctgggcctttgtctgcttataagaacaggcatgtagtcaaagccaactctccctcctcacattaccactcacacaaactctaacctatacattaactggttaagtactcactgggttcacaatctttattcgtaatttagtttgaatactttcattatatgactaaattgacaggatgctgaacactgatgactcttcagggaacaaaagttctaaatggggcgaagagaagaaagtaagtctgagtgaaggtggaagaagcgagataataagaaagtaacgccaggtacgatggctcacgcctgtaatcccagcactttgggaggccaaggcaggcggattgcctgaggtcgggagttcgagaccagcctggctagcatggtgaaaccccatctctactaaaaatacaaaaattagccaggcgtggtggcaggcacctgtattcccagctacttgggaagctgaggtaggagaattgcttgaaacccgggaggcggaggttgcagtgagccgaggctgcgccattgcactccaacctgggcaacagagtgagacttcatctcaaaaaacaaaaagaaaaaagaaaagaaaggaagacagtaacaagtgccctggctattagaggataattggcagtaattataactaagttttccactttgctactggagaattatcttttaagcaaagataattttcattgctcctttagaaactgaatgctttctattttcttttttctctttttctttgcttgtaaataattccttaaaaggcttaagtgggccgggtgctatggcttacacctgtaatcccagcactttgggaggccaaggcgggcggatcacttgagaccaggagttcgagaccagcctggccaatatggtgagaccccgtctctactaaaaacacaaaaatcagccaggcatggtggcgcgcacctgtaatcccagctgcttgggaagctgaggcagaagaattgcttgaacctgggaggctgaggttgcagtgagctgggattgagtcactgcactccagcctgggcgacagagtgtgagaccctgtctcaaaaaaaaaaaaaaaaaaaaaaaaaaaaaacttaagtgaatttccagtcagatagctcagtaaattaccctttcgtgcactctctttgttccgtatatattttataataggttaagtgggaagagagagagggagagagagagagaatagtccagtcaaaacgagataaacattttcatagactggaaaaaagaaaaaagcaatggtatgattcaagctaagccctagacttcgtaagctgtaagtcccagagaaagcataggtgaacagggagatagctcctatggggtgaaagggactaaaagtgcttctcaagacacggactaaagccagcttcacaaccctacatcaaagaggagctctagaaaagaagctaaacaaaaactgctgcccagcactaactagcttatttggaacagcagacctaacgagggagaaggacacaaatataaccttgctaaactaagcagcctgtgggttcattaactgtgtctctgatattccttggtagcataatagaacagaaaatctaaaatatcacattatcagacctgattctggactgaggcctttggccaatgtaaggaaaccccaaaactaccaggtatgatagaataagcatagagggagaaagaaacaaaaacaaataaaccaaatgtttgtgcctacaaataagaattccagacatgtaaagaaatgttcagttgggcgtggtggctcatgcctgtaattccagcactttgggaggccaaggcaagaggattgcttgagccaattagtttgagaccagccctgacaacatagtgagaccctatctgtacaaaaaattacaaaattagctgggtgcggtgccgcactcctgtagtcctaggagcttgggaagtcctgtagtttctgaatccttgagcccgggaggtcgggtctccagtgaccatggtcatgccactgcactccagcctgggcaacagagcaagactctgtctgaaaaaaaaagttcagaaaaaaactaacaaagtcaacaatcagaatatgaaatcattctagattaatttggggtataatgtgataaagactattcttaggatgcacagatacatgacagaatcataaatttaaaaaaaagacccaaaactgtgaaacaaaaacaggtagaaataaaacaagaacaggtttaaataagaaagaaccaactatcaatcattaaaatgaaaaagtactaattggaataaaaatccaataggataaaatctagatagcacaagcaacaaaaagagaaactttgatttttagatctatctagagtacttacaaaaaatcgaccaaatactatatagttttaataaatgtcaaaggatatatcagtccatggatcctgactgtaatgaaattaaattagaactcaataatgagagtgattaaaaaaaaatacttggccagacatggtggctcatgcctgtaatcccagcactttgggaagcagaggcagatggatcacttgagtccaggagtttgagatcagcctggccaacatggtgaaaccccatctctacttaaaaaaagaaaaaatagattggggaagttctcctggataatatcctgcagagtgttttccaacttggttccattctccccgtcactttcaggtacaccaatcagacgtagatttggtcttttcacatagtcccatatttcttggaggcttttttcatttctttttattctttttcctctaaacttctcttctcgcttcatttcattcatttgatcttccatcactgataccctttcttccagttgatcaaatcggctactgaggcttgtgcattcgtcacgtagttctcgtgccgtggttttcagctccatcaggtcctttaaggacttctctgcattggttattctagttagccattcgtctaatctttttgcaatgtttttaacttctttgctgtgggttcgaacttcctcttttagctcggagaagtttgattgtctgaagccttcttctctcaactcatcaaagtcattctccgtccagctttgttccgttgctggtgaggagctgcattcctttggaggaggagaggcgctctgatttttagaattttcagtttttctgctctgttttttccccatctaatgcaatatggattaaagacttaaatgttagacctaaaaccataaaaaccctagaagaaaacctaggcattaccattcaggacataggcatgggcaaggacttcatgtctaaaacgccaaaagcaatggcaacaaaagccaaaattgacaaatgggatctaattaaactaaagagctccttcacagcaaaagaaactaccatcagagtgaacagggaacctacagaatgggagaaaatttttgcaatctacccatctgacaaagggctaatatccagaatccgcaaagaactcaaacaaatttacaagaaaaaatcaaacaaacccatcaaaaagtgggcgaaggatatgaacagacacttctcaaaagaagacatttatgcagccaacagacacatgaaaaaatgctcatcatcactggccatcagagaaatgcaaatcaaaaccacaacgagataccatctcacaccagttagaatgacaatcattaaaaagtcaggaaacaacaggtgctggagaggatgtggagaaataggaacacttttacactgttggtgggattgtaaactatttcaaccattgtggaagtcagtgtggcgattcctcagggatgtagaactagaaataccatttgacccagccatcccattactgggtatatacccaaaggagtataaatcatgctgctataaagacacatgcacacgtgtgtttattgtggcactattcacaatagcaaagacttggaaccaacccaaatgtccaacaatgatagactggattaagaaaatgtggcacatatacactatggaatactatgcagccataaaaaatgatgagttcatgtccttcgtagggacatggatgaagctggaaaccatcattctcagcaaactatcgcaaggaccaaaaaccaaacaccacatgttctcactcataggtgggaattgaacaatgagaacacttggacacaggaaggggagcatcacattccagggcctgttgtggggtggggggagtggggaggggggagggatagcattaggagatatacctaatgtaaatgacgagttaatgagtgcagcacaccaacatggcacatgaatacatatgtaacaaacctgcatgttgtgcacatgtaccctagaacttaaagtataataataaaaaaaatagctgggtgcaatggcaggtgcctgtagtcccagctacttgggaggctgagacacaagaattgcttgagcctgggaggaagaggttgcagtgagctgagatcacgtcactgcactccagcatgggtaacagaactagactcttcaaaacaaaacaaaacagaaacaaacagaaacaaaaacaaaaacaaagctctacatcttttaggacaaaataatgctccctaaaaaaattgggtaaaaaggaaatcacaatggaaatgataaaatatttagaactaaacaaccatgaaagaattactataaccaaaacccatagatgcattaaaaacaaaacaaccaacaaaaatagtttaaaataaatgagttatgcatgcaattcacgaacctgtaaaagaataactagaaaagaccaaagaaggaagaaaatttttaaactaaactttgtaaaaatatgaaaaaaccttaggttcaaatgacagactaaaatctatttctttggacaaaaactaaatgaaaggcaaactacaagtaaacctaattaagcaaaaaaaaaaaaaaaaaagagtgaaagcatgaaaaggacataactaaagtatatacgtaggtatacatatttacatatacattactcaagcatattttattgtttaaatcttctgtttctttactgctctttggtgtttttgtttgtttgttttgagatggagtcttgctctgtctcccaggctggagtgcagtggcgtgatcttggcttcctgcagcctctgcctcccgggttcaagtgattctcctgcctcagcctcctgagtagctgggattacaggcactcaccatcacacttggctaatttttgtatttttagtagagacggggtttcaccatgttggccaggctggtcttgaacccctgacctcaagtgatccacctgcctcggcctcccaaagtgctgggattacaggcctgagccaccacaccgcaccatctttactactctttgttttatgtttttctgtgttaagtctcccatgatggcttcacgttttaaattttttccttgtaatactatcaatatctgcttaatattttgaatctataagatggtaaatatccaaattaacctgtggattcaatgcaattcacaacaaaaatctcacagatttttttttctgtggaaaatgaacaagagtcaggtacccaaattcaggacagctcattctgtcctttttgcaaagggcccaaaagggccaagataattgtgaaaaataaaaggatggagacatttacattacctgatgtgaagatgacttatcaaattattgtaattaagactgtggaagtcaggtgcagtggctcacacctataatcccaactacttgggagattgaggtgggaggatcgcttgaggacaggagttcaaaacaagcctgaacaacacagtgacaccctgtttctccctccttctcaaaaagaaaaaaaaatagataatgtggtattggcacatgattacataaacagaacagaatagaaagcctagaaatacagaagaaacattaaaaaaaaaaaaacagaatgagggaactatggactgtccacctaatggggctgatgtaactggttaaatacggaaaaaaacataaaactacatccctgctttgtgatctttttgtttttaagttccaaaagatcaaaggcctatatgtgaaaagcaaactttagggaccttcactggccgatccagaggaaatctaagcatcaaaaagagtaatgaaagtactagattattacactttgaatttttttaaaaatccatgagtcctaggaaaaatcaatatcgtgaaaatggccatactgcccaaggcaatttatagattcaatgccatccccatcaagctactaatgactttcttcacagaattggaaaaaactactttaaagttcatatggaaccaaaaaagagcccgcattgccaagacaatcctaagccaaaaggacaaagatggaggcatcatgctacctgacttcaaactacattacaaggctacagtaaccaaaacagcatggtactggtaccaaaacagagatatagaccaatggaacagaacagagccctcagaaataatgccacacatctacaaccatctaatctttgacaaacctgacaaaaacaagaaatggggaaaagattccctatttaataaatggtgctgggaaaactgactagccatatgtagaaagctgaaactggatcccttccttacaccttatacaaaaattaattcaagatggattaaagacttaaatgttagccctaaacccataaaaaccctagaagaaaacctaggcaataccattcaggacataggcatgggcaagggcttcatgtctaaaacaccaaaagcaatggcaacaaaagccaaaattgacaaatgggatctaattaaactaaggagcttctgcacagcaaaagaaactaccatcagaatgaacagggaacctacagaatgggagaaaatttttgcaatctacccatctgacaaagggctaatatccagaatccgcaaagaacttaaacaaatttacaagaaaaaatcaaacaaccccatcaaaaagtgggcgaaggatatgaacagacacgtctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactataaactagttcaaccattgtggaagacagtgtggcgattcctcaaggatctagaactagaaataccatttgacccagccatcccattactgggtatatacccaaaggagtataaatcatgctgctataaagacacatgcacacgtatgtttattgtggcactactgacaatagcgaagacttggaaccaacccaaaagtccaacaatgatagaatggattaagaaaatgtggcacatatacaccatagaacactatgcagccataaaaaatgatgagttcatgtcctttgtagggacatggatgaagctggaaaccatcattctcggcaaactatcgcaaggacagaaaaccaaacaccgcatgttctcactcacaggtgggaattgaacaatgagaacacttggacacaggaaggggaacatcacacaccggggcctgtcgtggggtggggagggatagcattaggagatatacctaatgtaaatgacgagttaatgggtgcagcacaccaacatggcacatgtatacatatgtaacaaacctgcacgttgtgcacatgtaccctagaacttaaagtataataataataagaaaatagcaaaaagacaccatgacacacgtagcctctcctgtcccaataaagtatatactctgggaaaaaaaaaatccatcagtccatagtgacattcaacaaaagacagagtcagtgaaaaaggaaaaaagtagaggtagctttttttttgtatagaagaatgtcagctaataaatatagaaggaatgatagaagttgaaaatcattattttataatctgcaacataattaaggcaaggatcaccgataggtcatcattaaatggttatttggaaacaggatatcaaattatcactccactaaatatttattagttccaaaggggaaatgtatctttacaatgcaaatatttggcaatcacaatcttaactaagtggtcaccatgtgcggtttttttttgagacagggtctcgctctgttgcccaggctggtgtgcagtggtgtaatcatagctcactgtagccttgaactcctggcctcaagtcatcctcctgccttggcctgccaaaatactgggattgcaggtgtgcacaaccacacccagcccatcatgtgcctttagatatgatacagtaggaggtatacaccatcacttgtgtggtgttttgttagaaatgtctgcccgaaatctaacgataaatagtcaaacaaaaatccagaatatgggacagtctatgagataactggccactatgtaaggatttaatattatgaagagcagaaggaggtaatagtattgtttaaactggaggagactataggcatataacagtcagatgaaatccattgaatctggacttttaaaaaatgtataaactgggccgggtgtggtggctcatgcctgtaatcccagcactttgggaggccaaggtgggtggatcaggaggttagcagttcaagaccagcctgaccaacatggtgaaaccctgtctctactaaaaatacaaaaaaattagctgagcatggtggcgggaggctgtaatcccagcaacttgggaggctgaggcaggagacttgcttgaaaccagaagatggaggttgctgtgagccaagattgcacgactgcactctagcctgggcaataagagcaaaactccatctcaaaaaaaaaaaaaaaaaagcataaacctttttctttgacaatttaggaaatttgagtatgaaaagaatgttggaagttgtgttgaattaacgattttttccctcaggtgtggtaatgatgctgtggatatgtaggagaatgtcattgtttcctggaaaatatgctgaaatatttatctttttttttttttttgagacactgtgtcactctgtcgtccaggttggaatgcagtggcgtgagcttggctcactgcaacttctgcttcctgggttcaagcgattctttcgcctcagactcccgaggagctggaattacaggcatgcaccaccataccaactaatttttgtatttttagtagagatgtggtttcaccatgttggccaggctggtgtcgaactcttgacttcaagtgatctgcccacctcagcctcccaaagtgctgggaattacaggtgtgagccactgcgcccagccgagataagctgaaatatttagaggtaaaatatcacaatgcctacactcactttcagatgttttgtcaaaaaggaaaaaaatacacatagagacagagagatagagagagcaaatgtgtcaagatgttaatagttgataaatataggtgagaggtataacagtattcattttagtattcaacttttctctgggtttgaaattctgcaaaataaacaagaatatttttgaaggtaaaaaattagagaataataataaaagttttatgaatttaggtgttcttaagagaaacaacatttacaaaccacaacaaaaagtcttgatacattttactgttttaaaactaaaactttggctggatgtcgtggctcacgcctgtaatcccaacactttgggaggcccaggcgggtggatcacctgaggtcaggagttcgagaccagcctgaccaatatggtgaaaccctgtctctactaaaaatacaaaaattagctgggcgtggtggtgcgtttctgtagtcccagctactcgggaggctgagacaggagaattgcttgaacccaggaggcgaaggttgcagtgagccgggattatgccactgcactccaacctgggcaacagagagagactctatcaaaacaaaacaaagaaacaaaataaaacaaaacacaaaaacctaaaacttctatactacaagatataacataaagcagtcaaagagataagctggcttgtaagtagatatttactatatataacaaacaaaggatcagtatctagaatatacaaataaactctatgcaaagaaaaaggagggatggggccaaattacccaatagaaaaattggtgaaggggtcaggcacggtggctcatgcctgtaatcgaggcagtttgggaggccaaggcaggaggattgcttgagcccaggaatgtgagaccagcctggaaaacatattgagaactcgtctctacaaaaagtaaaaaaaaaaaaaaaaaaaaaaattagctggatgtgttggtacgtgcctgtagtctcagctacgcaggaggccaaggtgggaggattgcttgagcccaggaggtcaaggctgcagtgagctatgatcacaccactgcactccagcctgggcaacacagtgagaccacagctctaaaaaaaaaaaaagagagagagagagagagagaaaagaaagtttggcaaaggatctgcataattaatttacaaaaggaaatccaaatggctaataacacaagaaagatgtttgttcaattttactagtaattagggaaataaaaaacaaaacactaacaataaaatgtttaataaaattataatacatattatgagattattaatataacgttatagtaaaatgtgtaaatacataataaaattattattacatttaaaaggctcacattatcagactttttttcttcccttatcttctgataaaataggaatttgtatacactgctggtgggagtacaaactggttaaaaaacattttaggtagggcacagtggctcatgcctgtaatcacagcactttgggaggctgaggcaggagggtcacttgagtttaggagttcaagaccagcctgggcaacataatgagacctcatctctacgaaaaagaaaaaagttagccagccacagtggtgcacacctgtattcccagctatcttgggaggctgaagcaggtggattgcttgagcccaagagttggatcactccactgtcctccagcctgggtaacagagtaagacgttgtctcaaaaaaaaaattttagaaattaatttcttaatacttagtaatctaggagcttcagatatcttaggactcagcaattatatctctagacagtttcatttcctgctgttctccctcttcctcattctgcttcagccacattggcttccttgtggttccttgatcctttcaagcaagtgcccatcttggcactttttcattcactgttctctccattatcttgattctttacttcaggactcagctttagtgtcaccttttccgaaaagcctttcctgacccaccctatcttaaagattactcattctctatgcccacaacttgctttatgtatttgatataccttagtttactttctttctcccacccttcctgatggtagattggataattgtttttcagttaataaaattttttttttaattgagatggtgtctcgcttttttgcccaggctggtcttgaactcctgagctcaagcagtcgtcccaccttggcttaccaaaatgctgggattacaggcatgagccacagcacctggcccattgttctcaattctttactgccccatcccaatattagaattatccagccatgcctatcaccacgtgactttgcaaagcctcccactgtagttgatggaatatatttctctgctcccttgatgttagtcatatcatggcatggtttggctaatggaatgtaagcagaagtgaccatgacaatcctgagttgagaccttaaaaggcattatgtatttctactcacctctcttgtacttctgtcccccactgtgggaagaatgtatctcaggcaggcaacttgttctagaatgatgaagacatgtgaagcagatgtaaacctgacctgaagattggagtccagcctagcccagccaaacatagacaagcccagccaagatcagccaaactttgatctgcagacctgtgagtgaggaaaaaaaaaagtctgttattgtatgtcactgagaacattcgaagtatttattgtgcagcattgttgcagcaatgcagctgactaatatatacccctctggaatgtaaacttcaggacagcaaggcttttacagttttgttcactggtatgtgctcagtgagtagaacagtgtctagtatgcataggtgtttaataaatatttgttgagttaattaatgcatttgtgctaaagccataaaactactcataatcccaaagggcaaggtaaatgttcaagtgtgcaaagaaacagatataattggctctgttataaatatagtcagtcagaagctggcaccaatgtatagtgaatgaaccctgcaatcaaatcaacaagcagcttaaactggcaatagatacatatgaaactaaagaatagttgataagaggatcagaaatagaaggtcccagtagaatttcaataaaatagatatttactcaaatattaccatcacctctgaattggagactattttcaaaaatagatggggcatcagctaagtgttccaaagaataaatgaaatgggctatagtcatccatgagctggctggtggcaaaaatagaagtcaaggaggccttataaaacagcccaatgtatatagataaatcaagagagcaaatgttaaagtatatagggaaaaagtgagtttaggtgtttttgaactattataacttttctttaagtacgaaatttttcctaattttttgtaacaagtaagaaatggtggctgggcgcaggtggctcatgcctgtaatcccagcactttggaaggccgagatgggtgaatcacctgaggtcaggagtttgagatcagcctggccaacatgccaaaaccccgtctctactgaaaatacaaaaattagccaggcatggtggcacatgcctgtaattccagctattccagaggctgagacaggagaatcgcttgaatccaggaggcagaggttgcagtgaactgagatcatgccggtgcactccagcctgggcgacagagcaagactcagtctcaaaaaaaaaaaaaaaaaaaaaaagaaaagaaaagaaaagaaaaggtttgttccagtatttccagaaataaaccaaatatgactaatcctgaacatgacaacttttgtggtcttgaatgacttaagtagcaattgtctagtttttgtgtgggacaatggaacatatattgccagaatgaccataggcagattgcttcctaccggaatgaccttctcttgtctgctgtttgttctttacactgtcctttgacttaactggaggtatgttgaggaactatcatactgtttctcttggaactttattacctcccttaggtgttgtgattaagaaccacaacagttttgagcaagtagtagattctgcctctttagctgggtgtccaatgttcagaacaatcctagacaaagattcaagtacatgtatgttgtttgaaaggtacaaatggaatgctgtggggagctgatgccccaactagcatcatcaacagttcctccttttcatattttgatctccacctcaagatgtaaagctgaacataaggtgggaaagagaagaggggaagtgaggaagtgaaaaagggaagagaagggaaccaataaaggatgcattatcaagcttgcttccactatggtcaataagagcttaatcctgcagagataatggaagcaacataaaatccatgcttcagagttatacctcccacacacaggggcagggatctggttgaggactactcagagccagatattaattccttagaacatctgggccagcttagggagagaatccttccctggctccagcaaaagtctttaggaaaacagatgcagatgttggctactggaagtctgccagaaaacacacaagcgttaaggcccacaggatacaggtagagcactgaaatcatctactactaggtctgagaaggtccacaggacacacactagtgatcaaaggaactaattagcactacggcccagaaagacaactcaaattaaagatgttatatcgttctcctcttgacaaatagacatcatctaccttagttgaaactagaatgctacttcttaggacattgacattccatctgtaactactttatacatgaagattcatcctgttttctaccacattatacaatacctggccccaaatactcctttttctcatattgtattcagtcctgttattctgagatgaagaagaagagtgtgaaatgggagaaagtattgatgccagctggatgtggtggctcacgcctgtaatcccagcactttcagaggctgaggcgggcagatcacttgaggccaggagttggagaccagcctggccaatatggtgaagccccatctctactaaaaatacaaaagttagccaggtgtggtggcgcatacctgtaatcccagctacttgggaggctgagatgggagaatcgcttgaacctgggaggtgaagacttcagtgagccaagattgcgccactgcactccagcctggatgacagagcgagaccccgtctcaaaaaagagaaagtactgatgccatttggggcattaagttcagcttctatcaatgatatactgggaaagagatgagccagaaaaatgagaaactgcctcctacctgaataatcactaagaaaatcataccaggcaagtctaggaaaacttcgctacttcatatgaggaggagggagctggtctcattcttggaccattgatacagatctaccaatctatatacaatgttgacatcatgtttaccactcagaaattggccctggcttgttttattttgatctcatttccttttcattcattaatttaacaaatatttcttgagtgcttacaatggatctgagataaaaagacagactcatgctgttttctggagcttgtaatttagtggagaagcagattatgccacaaataattacttagttacaattgtgttaaatgctaagaaggacaagtatagaatactatgagtgtgtaatacagagattactcaatccatgctgaagtgtaatgtcaaggaagacttcactaaggaagatttaatctaagatttgcagagtagagtttggccaggagaaggagcagctgaagaacagcatttgcaagaaggagtttaggatgttcctgatactaaaagaaagccagcgtggcttgagagcagtagtcacagaaaagagtggcaaagatgaggctggaaggatgtgaagagcagacaaggacaagattttggaggattagggtgacagaagataacatcaatttttgctattctacatttttgccaacatttgttgttgttaatccttttaaatttagccttcctagtgaatataaaatggcacctcattatgttttaatttgcatttccctggtgtttaacgattttgagtaccttttccacacccattcgtataacttcctttgtgtctttaatttgtcctcttatttttaaaattaggttatattttattattaattgtaggagttctttatgtattgtggatacaagttctttgtcagatatgttttgcaaatcttttctcccagcttgtggcttgcctactcattttcttaatagtgtcttttaatgaccagaagttttaaaaattatattaaccatatcagtttccagttacatgcattcatcactatagatctgagttactacttgatggcacatctcatcagactgaataacttcttttaacatttcttgtggtggaggtctgctggcaatgaattttctgttcttatgtgtctgagaatggctttatttcactttaattgttgaaagataattttgctggatgtagaattctgagttgacaatattttgtcttttgacattttagcgatgtcattccattgttttctaggccccattatttccatcgagaagtcagctgatatatatatatatatatatatataatatattatatataatatatatataatatattatatataatatattatatataatatatataatatattatatataatatatataatatattatatataatatatataatatattatatataatatatatataatatatatgtatattttatatattatatatgtattatatatattatatatatacacatacatacacacacacacacatacacatataattgttcctctgtcacatgtggctttcctctggctgctttcaagactttatttttggtttcagcagtttgattacagtgtgcttaggtgtggagtttctttgtattcatcctactttgaattctttgagctttttggatctgtatgtcaaaatcttttataaaatttgatcagttttcagccattactttttcaagtatttttttctgcctcaatcctactcattctagggctcttgttctacttcttgttgttattcaacaggactctgatgctgtttgtttttcttcagtcttcttttcctctccattcttcagattggtccaattctattaacttatttccaagttcactggcacttttttcctcactgcctccaacctgctgttgagaacatacagtgaatttttcatttcatttcatttttttaattatttttttttactgctccttgtggagcagggttaacccataggccaatttttaaattttacttgttgtatttttcaattccagaatttctagtttgttttatactttctgtatccatgttaagaggctgtaactgttcattcattattcatttatcttctaagttattataaaaatgataattacttttactcaagtaaaagtaatgataacttttacttgagtatggattatattttcctgtttcttcacaggtttagtgatttttttaattgactactgtacattatgtttgatacattgtaacaacctctacacttttccatcttcctccgaagatgagtttgctctaaaagacagttaacttgcctgacctcattctccaaatgctgtctcctacacagtaggcaacaggtaaaatcttgcacagtcctttaagcttccaaatgctgtttttccataaggctctccggagtcacccccatggatatgtagtttagtcatgagccaagaatgtagtctgattttatatgcaggtcttaaagctcatctcctctgcaacccactctttttcatgatttccccctaactttctggatactctactaggctgatattttgttttttgacacatcaagccagtaagccatggctttctacttcctgagctgcatagaagctggggagttatctcaggcaaaaacccacaaacccacaaatctctgactttatagacacctttgaagggtagacttccctccagtttgtgactatttttggtcactcttcaataccttcaaagtattgcttgttgttgtgttgggttttatgcactattttctttacattttctttcttttttgcatttttaaaaattgagataaaccatataaaatttatcatttgaaagtgtacaattcaccagactttcttgacaataatttttaatagactttatttttcagagcagttttggttcacagcaaaattaagcagaagttataaagatttcccaaatacccccagtccacacacatgcatagcctcccctgttatcaataacccctaacggagtgtacacttgttacaactgatgaacctacactaacacatcattgtcacccaatgcacatagtttacatttgtgttcactcttggtgttgtacattctgtaagtttgaataaatttgtatgacatatatccaccattatagtatcttacagagtagtttcactgccctaaacatcttctggtctctgcctaatgatctctccctcatggctaactactgtcaaccactcatctttatactgtctccatagtttagccttttccagaatgtcatatcattggaatcatgcagcatgaagccatttcagactggcttctttcacttagtaatatgcacttaagtttcctttgtatcttatcatggcttgatagctcatttccttttagcactgagtaatgttattttgtttggatgtatcagagtttatttatccatttgcctaccgaaggacattttggttggttccaagttttggcaattataaataaggctgctatgtgcaggattttgtgtggacataagttttcaactcaactgggcaaataccaaagggcataattgctgaattatatggtaatggtatggctgttgctatggggttgttttggggatatatgggaaatctctgtagcttctgcttaattttgctatgaacctaaaactgctctaaaggttaaagtctattaaaaatgattgtaaaaaaacccaactgaatcatacacttttgaatggtgaattttatctcaaattttaataaatgcaaaacaaaaaaagaaagaaaatataaagaaaaccgtgcataaaaaccaaacaacaaccaccaccaccaattcattgaaactaccaaactttcttccaaagtggctgtaccattttcatccctacctgcaatgcataagagttcctattgctccacatccttgactgcatttggtgttgacagtgttctggattttggctaatgtaataggtgttgtggtgtttcattttaatttccatttccctgatgacataggatgtggaatttttttttattatactttcagttctagggtacatgtgcacaatgtgcaggtttgatacatatgtatacatgtgctatgttggcgggctgcacccattaactcgtcatttaacattaggtatatctcctaatgctatccctcccccccccgactccccccaccccacaacaggccctggggtgtgatgttccccttcctgtgtccaagtgttctcattgttcaattcccacctatgagtgagaacatgcagtgtttggtttttggtccttgcgatagtttgctgagaatgatggtttccagcttcatctatgtccctacaaaggacatgaactcatccttttttatggctgcacagcattccatggcgtatatgtgccacatttccttaatccagtctatcattgatggacatctaggttggttccaagtctttgctattgtgaacagtgctgcaataaacatacgtgtgcatgtgtctttatagcagcatgatttatactcctttgggtatatacccagtaatgggatggctgggtcaaatggtatttctagttcctgatccgtgaggaatcgccacactgacttccacaatggttgaactagtttatagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgaattcattgtagattctggatattagccctttgtcagatgagtagattgcaaaaattttctcccattctgtaggttccctgttcactctgatggcagtttcttttgctgtgcagaagctctttagtttaattagatcccatttgtcaattttggcttttgttgacattgcttttggtgttttagacatgaagtccttgcccatgcctatgtcctgaatggtattgcctaggttttcttctagagtttttatggttttaggtctaacatttaagtctttaatccatcttgaattaatttttgtataaggtggaaggaagggatccagtttcagctttctacatatggctagccagttttcccagcaccatttattaaatagggaatcctttccccatttcttgtttttgtcagatttgtcaaagatcagatagttgtagatatgcggcattatttctgagggctctgttctgttcctttggtctatatctctgttttggtacaagtagcatgctgttttggttactgtagccttgtagtgtagttcgaagtcaggtagcgtgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttgggcagtatgaccattttcacgatattgattcttcctacccatgagcatgttcttccatttgtttgtctcgtcttgtatttcattgagcagtggtttgtagttctccttgaagaggtccttcacatcccttgtaagttggattcctaggtattttattctctttgaaacaattgtgaatgggagttcactcatgatttggctctctgtttgtctcttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttccttctcctgactgattgccctggccagaacttccaacactatgttgaataggagtggtgagagagggcatccctgtcttgtgccagttttcaaagggaatgcttccagtttttgcccattcagtatgatattggctgtgtgtttgtcatagatagctcttattattttgagatacgtcccatcaatacctaatttattgagagtttttagcatgaagagttgttgaattttgtcaaaggccttttctgcatctattgagataatcatgtggtttttgtcgttggttctgtttatatgctggattacatttattgatttgcgtatgttgaaccagccttgcatcccagggatgaagtccacttgttcatggtggataagctttttgatgtgctgctggatttggtttgccagtattttattgaggatttttgcattgatgttcatcagggatattggtcttaaattctctttttttgttgtgtctctgccagactttgttatcaggatgatgctgccctcataaaatgagttagggaggaatccctcttttactattgattggaatagtttcagaaggaatggtaccagctcctccttgtacctctggtagaattcaggtgtgaatccatctggtcctggacttcttttggttggtaagttattaattattgcctcaatttcagagcctgttattgatctattcagagattcaacttcttcctggtttagtcttgggatggtgtatgtgttgaggaatttatccatttcttctagattttctagtttatttgtgtagaggtatttatagtattctctgattgtagtttgtatttttgtgggatcggtggtgatatcccctttatcattttttattgcatctatttgattcttctctcttttcttctttattagtcttgctagtggtctatcaattttgttgatcctttcaaaaaaccagctcctggattcattgattttttgaagggttttttgtctctatttccttcagttctgctctgatcttagttatttcttgccttctgctagcttttgaatgtgtttgctcttgcttctctagttcttttaaatgtgatgttagggtgtcaattttggatctttcctgctttctcttgtgggcatttagtgctataaatttccctctacgcactgctttgaatgtgtcccagagattctggtatgtcgtgtctttgttctcgttggtttcaaagaacatctttatttctgtcttcatttcgttatgtacccagtagtcattcaggagcaggttgttcagtttccatgtagttgagcggttttgagtgagtttcttaatcctgagttttagtttgattgcactgtggtctgagagacagtttgttgtaatttctgttcttttacatttgctgaggagtgctttacttccaactatgtggtcaattttggaataggtgtggtgtggtgctgaaaagaatgtatattctgttgatttggggtggagggttctgtagatgtctattagatctgcttggtgcagagctgagttcaattcctgggtatccttgttaactttctgtctcgttgatctgtctaatgttgacagtgggatgttaaagtctcccattattattgtgtgggagtctaagtctctttgtaggtctctaaggacttgctttatgaattttaaaaatattttttaatatattttttgccgtctgtgtatcttctttagtgaggtgtctgttaagatctttggcccatttttaaattaggttatttgtttttttattgtgaagtttcaacaattctttgtatattttgaataacagtcctttagcagatatatttttgcaagtattttcccccagtgtgtgacttgcttttaatataaataaatatatataaacatatatatacatatacgtatatatacacacatacatatatacatgtatacatatatatatttaaagacaaggtcttgctctgttgccctggctatagtaaagtggtgccatcataactcactgcagcctttaactgctgggcgcaagcgatcctcccatctcagcctctggaatagctgggactacaggtgggacatgccaccatgcctagctaatttgtgtatttttgtagagatggggtttggccatgttgcttttattctcttgacagtgtctttcacagagcagaaagttctaatgaagttcagtttatcaattatttatttcataaatcatgcttttggtgtgtctaaaaagacatcatcatacccacagtcacttagatttttttctatgttatcttctaggagtcctatagttttgcattttacatttaggtctgtggccaattttgaattaatttttgtgaagggtattatgtctgtatctagattcaatttttttgcatgtgtatgtccagtgatttcagcactatttgttgaaaagattatctttgatccattatgttatctttgcttctttatcaaacatcagttggctgtgtttatgtggctctatttctgtgttctctaatctgttccattgatttatttgtttattttttcacgaataccacactgtgttcatcactatagcttcacagtaagtcttaaagtcagctagtgtcagttttctaactttgttcttctccttcaatgttgtgttggctattctgggtctcttctccatgtaaactttaggataaatttgtttacatctacaatataacctgcttggattttttttccagtttttttattgtggtaaaatatacacaacataaaatttgccatcttaaccacttttaagtgtacacttcagtgttaaatatcttcataatattgtgcaaccatcaccatcatccattgataactctgcatcttgtaaactcaaaactctatacccgttaaacaataaccctccattctccacttcccccaactcctagaaaccacctttctattttctgtctctatgattttgactactgtaaatatctcatgtaaacagaatcaaacagttttagtgaatggtgcatttcacttagcatactgtcctcaagtttcattcatattatagcatgtgtcagaatttccttcctttttaggagtgaattatgttccattgtatgtatatatcatattttgcgtattcactcatctgttgatgggtacttgggttgcttccatggtttagctattgtgaatactgccactatgaacaacagtgtacaaatgcctcttcaagacccttctttcaattattttgggtatatactcagaagtggaattgctggatcatatggtaattctatttttaattttttgagtaacttccatactgatttaaacagtggctacaccattttacattccatcaacagtgtacaagagttccaatttctccacatccttgccaacattttaatataataaccgtcataatgaatatgaagttgtatcttactgtagttttgatttgcatttccctaatgactgagatgttgtgcatctttttatgtgcttgtcagtcatttacatatcttcttcagaggaatgtatactcaagtcttttgcccacttttgaattgggttgttaggatttctgatgttgagttctgtattgttttattatctcaaaagtttaaataagatggtctgctgctatacttgttcttgctgtccactgtattagcactttccctgatgtgctttggaagttgatccatgaatttcttaaactttttgctggaattcctttaaaggggtctgattagatggtgaaaagtagactgagacaaccttcaagtgaccatgtcattgttttcttgctatgtctttggcttgatgattaagatacaattctttttaaaaccaaatggcatttgttattatgtttcccaaattaggaatctattttagttaatattttaaagaaacacaaaggcataacaaatactatcattgtttttactccagagtgttaatgaatgtaaagaggttagagagatgtagtgtttaattaatgatgcttattttaactatatttaacatgagtgatttttcattgtctttaaagaggaataatgcttattgattaaaggtgagaaattatggttaagacactgattctgtgtcaaggtctttgactacattatgcattgtgcaaataatttcatttttcatgaatgccttagttttcctactataaaataaagacaatgatgaataaaaaagaagaagaagtttctctacagattctggatattaaccctttatcagatatatgacttgcaaatatagtctcccattctgtggattgcccttttactctatttatattgtcatttgaggcagaaaaattttaaattttcatcaagtccaaattgtctatttttttatttttcttcctcttgttctttgtctttttttttatgagtcagggtctcactatttttcccaggcaagtctcgaattcctgggctcaactgatccacctgcctcggcctgtcaaagtgttaggattacaggcatgagctactgtgttcagcctccacttttttgttgttgtgtcctgtgtttttggtgtcatgtccaagaaatccttgccaaatccaacgttgtggaacatgttccttacatttttcttctaaaaaatattttatagttttaggtatttaatccatgttgagttaatttttgtatacagtgttagataaggatccaactccattcttttgcaagtggatgtcgagtttttctagcaccatttgttgaaaagaccatatatatgagggtttatttctgagctctctattttatttcatgggctacatgtctgtctttacgccagtaagttttgaaatcaggactcgtgagtcctccagctttgtctgtctttttcaagattgttttcgctatttaaagttccttgagattccatatgaattttagaatgggtttttctatttctcaaaaaatgtcattgggattttgatagggattgcattgaatctatagatcactctggacagtattgatcttaacaatattacatcttccagtccatgagcatttatttatatcttctttaacttatttgagtaaattttgcagttttcattatacaaatcatttacctccttgggtaagttatttcctaagtattttattctttttgatgctattgtaaatggaattgtatttataatttccttcttagattctccttctccttcttcttcttcttttgagacagggccttggctctgtagcccaggccggagagctgtggcatgaccacggctcactgcagccaccacctcccaggctcaagcaatcctaacacctcggcctcaagagtagctgggactacaggcacgcagtatttagcctaattttttcaatttttttgtagagacagtgtctcactaagttgcccaggctggtctcaaactcctgagctcaatgaccttccacctcagcctcccaaagtgatgggattacaggtgtaagccaccacacccagcttcctcattgttaatgtatagaaaggcacctgattttttgtgctgactttgtatcctgctactttgctgaattcatttattagctctaacagttgtgtgtgtaatccttagggttttctacatataaaatcattcatctgcaaacacagataatttaacttcttgctttctgatttggaagccttttatttctttttcttgcctaattgctccagctagaacttagtactatgttgatagacgtggcaaaagtgggtaaacttgtcttgtacctggtcttggaggaaaagctttcagtttttcaccactgagtatggtgtttgctgtgggtttttcacacatagcttttattatgttgaggtaatttccttctatttctagtttgttgagtgtttttatcatgaaagggtgttggagtttgtcaaatgctttttctacatcagtcaagatgatcatgtgctttttccattcattctgttaatgtggtgtattccattgattgattttcatatatggaaccattgttgcattccagaaaaaaaaaaaccacatggccatggtgcatattccttttttatacgttactaaattcggtttgctggtattttgttgaggattttatatcaatgctgatatggttcggatgtgtgtcctccttcaagtctcatgctgaaatgtgatccccaatgttgcaggtggggccaagcactattcccttggtgatgagtgagttctcactcagttagtttacatgagagctggttgtttatttttttgtttatttaatttttttactcagatcatttcttctccagaatttttcatttggtcgtttaaagaatcctggctcctcctcctctctcactccctctctcaccatgtgatacaccagctcccgctttgccttcctaaggcctcaccatagacagatatggcactatgcttcttgtacagcctgcagaaccataagccaaaataaacctctttctttataaattgcctagtctcaggtattcctttactgcaacacaaaacagactgacacaaatgttcataatactttaatctctgaaagttataatgagttataacactctaatttgaactataccagcttaacttcaataacatgcaaaaattctactcctttacagctctgtctccaccctttggttgatgatgtcacaaaattatattttacagattgtgtgccccaaaatataaactaacaagtctttttttttttttttaatggagtctcactctgtcgcccaggctggagtgcagtggtgcaatctcagctcactgcaacctctgcctcctgggttcaagtgattctcccacctcagcctcccaagtagctgggattacaggtgcccactaccgcgcctgcctaatttttgtatttttagtagagatggggtttcaccacattggccaagttggtctcaaactcctgatcttaagtgattttcccaccatggcttcccaaagtgctgggattacaggcatgagccgccatgcctgaccataaatgaataattcttttaaatgcactactctcttaaattgtgtagaaaacacaatatggggttgtaaaccaaagttacaataatactaaaaagtgttagtcttttaaagcatgtagaaaacaaaaagtgaagttacaaaccattgttataataatactagcttttataattgccataaatttacctttatttagatctgtatttgttcatatggctttgagttactgttgagtgtccgatcatttcatcctgcaggactcccttgagtgtgtttttcttattttgtctcactagtgatactttgagcatttcttgcagggcaagtccagtggtaacaggctccctcagtttttatttacctggaaaggtcttaatttctgcctcacttttgaaggacagttttgctgaatataagattcttggttgacagactttcccctgcctgccttttagcactttgaatataatggcccacagccttctgaccttcaaaggtcctgatgagaaaccttctaataatcttattgaggatcccttatatgtgataagtcacttttctcttgcttctttaaatattctctcattgtttttggtttccaaaagtttaattacaatgtgtctcagtgtggatctctgagttcatcttacttagagttttttgagcttcttggatgtttatactcatgtctttcatttaatttgggaagttttcagtcattatttcttcaaatattctctctgccccaactctctctctctcctctttctgaaattaccataatacacacttttgtccacttgattgtgtcccacaggtccctttggctcacttttcttcaatctttattctttctgttcctcagactcaatactttccattgtccttcttcacattcactgattctttcttctgcctacacaaacctgccttttctttctttctttttttttttttttttgagacaggatcttgttctgtcctcttagtaaaatttttatttcagttattgtactttcaactttagaatttctttttgggccgggtgcggtggttcacgcctgtaatcccagcactttgggaggccaaggcgggcgaatcacaaggtcaggagattgagaccatcctggctaacatggtgaaacccggtctctactaaaaaaaaaatacaaaaaattagccaggcatggtggtgggtgcctgtagtcccagctactcgggaggctgaggcagcagaatggcatgaacccgggaggcagagcttgcagtgagccgagattgtgccactgcactccagcctgggcaacagagcgagactccgtctcaaaaaaaaaaaaaaaccaaaaaacggctgggcgcggcggctcacacctgtaatcccagcactttgggaggctgaggcaggcggatcacgaggtcaggagatcaagatcatcctggctaacaaggtgaaaccccatctctactaaaaatacaaaaaattagctgggcgtggtggcgggcacctgtagtcccagctactcgggaggctgaggcaggagaatggcgtgaacctgggaggcggagcttgcagtgaaccgagttcacgccactgcactccagcctgggcgacagagcgagactccatctcaaaaaaaaaaaaaaagaattcctttttggtttctttttaggtttgctgtttttagattaatatttccattttatttatacattattttcttgattttttttccccacatcttcctttagtgatttgagcatctttaagacagttgttttagaagaatcatttgaacccggaaggcagaggttgcggggagctgagatcacatcactgcactccagcctgggtgactgagaaacactatctcaaaaaaaaaaaaaaagttgttttatttatttatttatttatttatttatttttgagatggagttttgctcttgttgcccaggctggagtgcaatggtaggatctcagctcaccgcaacctccaccttccaggttcaagggattctcctgcctcaaccttcttagtagctggaattacaggcatgtgccaccacgcctggcaaattttttgtatttttaatagagatggggtttctccacgttggtcaggctgctctagaactcccaacctcaggtgatccgcctgcctcggcctcccaaagtgctgggattacaggtgtgagaaaagacagttgttttaaagtctttgtttggtatgtttgctatcaggtctttttcaggcacaatttctgttgctttattattattattttttgaataggccaaacttttctgtttctttgtataacttattttttttttgttgaaaactggacagttggatctaataatgtggttaactctggaaagaagatgctctccctttcctacaatagcaggtaaccatcctccacccctgagccacttggcaggcagtttgtgcatgtgttcctagagcaccttgcaaacatcatgcgggagcccaggtggggaaaaaggtccctgtccttcaaatattaggcatctaagccatgattgctgattaccgcttctgatcatagaggtgcagacaaagaggttggctgccaaggtttgctatttttattactgtttatttttatttgggtaggcagtctctgtgccaagaatcatctgagatgtgaatttttttagtttttttttttttttgagacagagtctcactctgttgcctaggttggagtgcagtggcgcgatcttggctcactgcaacctccatctcctgggttcaagtgattctcctgcctcagcctcccaagtagctgggactacaggcacatgccaccatgcctggctaattttttgtattttttgtagagatggggtttcaccatgttagtcaggatggtctcgatctcctgacctcgtgatctgcctgccttagcctcccaaagtgctgggattacaggcgtgagccaccaggcctggcaaatttttttaacttttaagttcaggggtacatgtacaggtttgttatacagctaaacttgtgtcatgaaggtttgttgtacagatcatttcatcacccaggtgttaagcctagtatccattagttatttgtcctaatcctctccctcctcccaccctccaccgtctggtaggccccagtgtctgttcccctctatgggtccatgtgttctcatcacttagctcccatttataagtgagaacatgtggtatttggttttctgttcctgtgtttgctaaggataatggcctctagcttcatccatgttcctgcaaaggacctgatcttgtccttttttatggctgcacagtattccatggtgtatatgtaccatcttttctttatcagtctacctttgatggacatttatgttgattccgtgtctttgctactgtgaatagtgttgcaatgaacatatgcatgcgtctttttttttttttttttgagatggagtttcactcttgttgcccaggctggagtgcagtgccgcgaactcagctcactgcaacctccgcctcccgggttcaacgattctcatgcctcagcctcccgagtagctgggattataggcaccggccaccatacccagctaattttttgtacttttagtagagatggggtttcgccatgttggccaggcaggtcttgaactcctgacctcagatgatctgcctgcctcggcctcccaaagtgctgggattacaggcgtgagtcaacacacccggcctgcatgtgtctttatgatagaacaatttctattcatttgggcctatatctaataatgggattgctgggccaaatggtagttctgtttttaggtctttgaggaaccaccacactgctttccacaatgggtgaactaatttacactcccatcaacaacatatacatgttcctttttctctgcaactttgccagcatctgttattttttgactttttaataatagccattctgactggtgtgagatggtatctcattgtggttttgatttgcatttctctagtggtcagtggtgttgagttttttctcatatgcttattggccacatgtatgtcttcttttgaaaaatgtctatttatgtcctttgcccactttttaatcgttttttttccttgcaaatttgtttaggttccttatatatgctggaaatcaggcttttttccagatggatagtttggaaaattttctcccattttgtaggttgcctgtttactctgttgacagtttattttgctgtgcagaagctctttcatttaattagatcctatttgtcaaattttgcttttgttgcaattgcttttggtgtctttgtcatgaaatcttttcccgttcctgtgtacagaatggtaattgcctaggttgtcttccagagtttttatagttttgggttttatgtttaagaatttaatccaccttgagttgatttttgtatacgatgtaaggaaggggtccagtttcaatctctgcatatggcgagccagttatcccagcaccatttattgaatagggagttctttccccattgcttgtttttgccagctttgtcaaagatcagatggttgcaggtgtgccaccttatttctgggctctctattctgttccattggtctatgtgtctgtttttgtaccagttgatgtagaaacttaaggtcctctcagatcttttctgagtttttccctgtgcattcatggtcactttctgcttttccccatatatatagttatgtttcaatgtcttagtctttcaagtctggatcccaaaagaagaaaaaagagaaaaatgaaggggagaaagaaagggcatcaaccacttaaatgccagtcctttcaatcccttggaagtcacttcagctggagtgggaggggcttgcaacaattggggaagatgcaacaacaatggcagccaacctctttgtctgcacctctatgatcagaagcagtaatcagcaatcatggcttagatgcctaatatttgaaggacagggacctttttccccacctgggctcccacaagatgtttgcaaggtgttctaggaacacatgcacaaactgcctgccaagtggctcaggggtggaggatggttacctgctattgtattcaggagctgaatttgaccaaatttatactcactttagcatccaagccttctcctggatggtgcaagccttcagtagactctagaatttcaaaatagtttcatcagacaaattctgccagtgcaattgttgttaggttgggagacagattcctggtgccttctattctgtcatcttcccagaatcctgtatcaagtagctgggattttaactgggaatgtattgaatctataaagtcaggaagaattgacatcttaataatattaagtcttcctcagtatggcgattcctcaaggttctagaactagaaataccatttgacccagccatcccattactgggtatatacccaaaggattataaatcatgctgctataaagacacatgcacacgtatgtttattacggcactattcacaatagcaaagacttggaaccaacccaaatgtccatcaatgatagactggattaagaaaatgtggcacatatataccatggaatactatgcagccataaaaaatgatgagttcatgttctttgtagggacatggatgaagctggaaaccatcattctcagcaaactattacaaggacagaaaaccaaacaccgcatgttctcactcataggtgggaattgaacaatgagaacacttggacacaagaaggggaacatcacacacggggcgtgtcatggggtgggggaggggggagggatagcattaggagatatacctaatgtaaatgatgagttaatgggtgcagcacaccaacatggcacgtgtatacctatgtaacaatctgcatgttgtgcacatgtaccctagaacttaaagtataataaaaaataatataagtcttcctattcatgaacaataaatagctcttgatttatttctttgatttcttccatcagagttttgtattttccctcatatagattatatgcatattttattagatttatatctaagtatttcatttttggtggtgctaacgtaaatggtacgatgcttttaatttcacattctactagtttactgccggtatatttagctggtatataggatagtgattgaaatttttatattgactttgtatcctgcaatcttgctataattgtttattagttccagaaggtttttttgtaaattcatttggatttttacatagaaaatcatgtcttctgtgaacaaagacagtttttatttcttctgtccaaatctatataacttatttccttttcttttcttatttcattagctaagagttctagtacaacattgaaaaggagtggtgaaagggaacattctggcctcgtacctgatcttagcaagaaagcttccagtttcttaccttaagtatgttgttagcttcaggctttctgtagatgttctttatcaagttgaagacattctcctctattcctacttcaatgaaagttttttttttttttgagatggggcctcaccgtgaacccgggaggcggagcttgcagtgagccgagatcccgccactgcactccagcctgggcgacagagcgagattccggctcaaaaaaaaaaaaaaaaaaaaaaaaaaaagagatggggcctcactttattgctcaggctggaattcagtggcgtgatcatggttcactgcagcctcgacctcctgggctcaggtgatacctcctgaggagctgggactataggtgcatgccaccacacccagataatttttggattttttgtagacaattttcgccgggtgcagtggctcacgcctgtaatcccagcactttgggaggctgaggtgggtggatcacctgaggtcaggagtttgagaccagcctggccaacatggcgaaaccccatccctactaaaaatacacaaaattagctgggcatggtggtggatgcctgtagtcccagctactcaggaggctgagtcaagagaatggtgtgaacccgggaggtggagcttgcagtgagccgatatcgcgccactgcactccagcctgggcgacagagcgagactccgtctcaaaaaaaaaaaaaaaaaaaaaagaaagaaagaaaggaaacaaggagacaatagaggacagacagggcaagaagcattaaaagatattcttcttagtaaatatgaattaacagagaccagttttaaagtacgaattctctaagaggatagttaaaatttcagtcataccttaaatcagattattcaaatcaatcatatagtgatatactgaaatattactaagcagacgctttgatagttaagaaaagagaaggaagaagaaactttgcaaaggaaaggtctagataggggaagaattttgacagctttcaggcaggatgaaggggctaattacctggaggacagggatactgaaaaagcatgaaggcatgaaggagattgttaatgacaaactttacctcctttataattttgcctaaaaccatggaggcatcagatgtttgactggcttgaaaacctgtaactttcattttcttttattcatacctgcattcccatgcatcgtatttaaataaatattcttaaaaagtaaaaacgaaaaatgaaatttcctcagccatttatattcctttgactctagcctcttgtcataaatgcttagctttactatcttccttcttttctcgtcctcttttactttttgctgccccattctttgatggaacaaaatcctatttccttctattttttttacacacagcaattcatgtttctctagtctttatcccaaaatcagctctggggctatggagattcaaaagctcagctaattatttgaaaaccttgtgtttcaaactctggccattagaaaagatccataccctctaataccctagtattagaggaggggtttattctgttattacattttctctttggagtgttttgcaaagctgctgcacccattttttttctaagagtagactgaaaaaaagaccaaacacattattaattgtggtaattttcttgcttatctttctgttctgggaaatgactatagcttttctgcctttagaggggtattagctccactgctctcttcaagctgtgcttttggatttgtgccaggccttactgggtagctaagctagttcaaaggggcagcatatgcagtaagatctatggaagaagcagtacttccagggtatcggttgttacatcttcctcttctacctcactaccctaacttaccatcagaactaagaagaaactttacttatatggatgaacaaaagaacaaaataatcaacactcaaaaatcagaaactaatttaaaaattagcaatataaccaattagaaaatgtaacaataaactatattcaaaatagtaaagaataaaacacccaagaataaaaataactgtagaagatatatatgaagaaaactttaaaactttcctacaggacataacaaaagactgatttcaatagtggcataccacataatcactttctttcctcctctacagctagagataactatacgatatatttctgtccaatgagacaatagagtaaacgtgtatttgctttgtaaacactaatagtgctgctctcagctttttcctttttgttttgagatggtctcgttctgtcacccaggctggagtgcagtggtgcttgatcatggctcactgcagcctcaacctcctgggttcaagcaatgctcctgcctcagcctcctgagtagctgggacttcaggtacatgccaccatgcctggctaattttttttttttttttttttgagacagaggctctctcttgttgcccaagctggagtgcagtggtacgatttcggctcactgcaacctcccctcctgggttcaagtgattctcctgcctcagcctcccgagtagctgggattacagacatgtaccaccacgcctggctaattttgtgtttttattagagaaggggtttctccatgttggtcaggctggtctcgaactcccgatctcaggtgatccgcccagctccgcctcccaaagtgctgggattataggcgtgagccattgcgcccggcctgcctgctaatttttaaattattttttgtagagacagggtttcactatgctatccaggctggtcttaaactcctgggctcaagtgattctcctgcctcagcctcccaaatactgtgattacaggtgtgaaccactgtacccagcctcctctggtcttaaatgctattgtgatggccagagctgcaacagtcatcttggatgtatgaagaaaaagcatgaagtcaagagccaacatactgaggatggaagagcagaaatacagaaaaaccgttaagtcctcaatgacagtgttgagcaggggaaactgccaagaactacctacttccagaattcttgttatatgagaaaattaaagccatattttcaaagccagtattagttggattgtctattacagggagctacatacttttctagcaaagtgtaaatactacaaaagacaataagtctaatatcagccaggtgcagtggcacatgccaataactcaggaggctgaggtgggaagactgcttgagcccaggagttcaaatccagcctgggcaacatagcaagaccccatctccatacttgatcttagccaaaaggcgataagcagtaagatccgatttctaaaaaaaaaataaaataaaatcagatgatggaagacaaaaagaataaagggaaagaacaggaaagattccattatcaattgcgtccttctcataacagtcattagatcaatccaaagaaaatgatcattagggcatatataaagttattataaatgcattcaatagaaaaaattcaaacattctaaattatcggaataaatataaacaaaaacaaaggaaaggaaacacagaccacattttgaaaataattaaggctatagacatgaaaagcatatcccaataatatgatatattccaaaccaaatacaatttgtgtaaataaatgtgaatacttgggagtctctctaagccttctctggctagaagggctgcccataaaaaaatttaaaaacatttttaggctggtcaccgtggctcacacctgtaatccctgcactgtgggaggtcaaggcgggcggatcacgaggtcaggagatcgagactatcctggctaacatggtgaaaccccatctctactaaaaatacaaaaaattagccaggcatggtggcgggcgcctgtggtcccagctactcaggaggctgaggcaggagaatggcatgaacacgggaggcagagctggcagtgagcaaagatggcgccactgcactccagcctgggcgacagagcaagactctgtctcggaaaaaaaaaaaaaaaattagctgggcgtgttggcacatgcctgtagtcccagctacttaggaggctgaagcaggagaattgcttgaatccgggaggtagaggttgcagtgagccgagatcatgccattgcactccagtctgggtaacagaacaagaccctgtctcaaaaaagaaaaaaaaattaaaaattaaaaattaaaaaaagtgaatacttaatattacctagtaggctgggagcagtggatcatacctgtaatcccaacacactgggaggctgaggtgggagaattgtttgtggccaggagttccaagaccagcttggagcaacatagcaagaacctatctctataaaaaaaaaaaaaaagtatatataaaaggaaaaattgacaaattgcatttcatgaaaatcaaaaacttctgttctgtgaaagaccccattaagaagaggaagaacaagctatagagtggaagaaaatatttgcaaaccacatctgacaaaggactaggatatataaagaactttcaaaccccagcaattaaaaaagcacacaaaggaaacaatccaatgagaatgggcaaatacatgaacaggcatctcaccaaagaggatatacagatagcaaataaacacatgaaaagatattcaacatcaatagacattagaaaaatgcaaattaaaaatcacagtgagacattactacacatctattggaatggctaaaataaaaactagtgatatcaccaaatgctttgaaggatacagagaaaccagattatacagatattactggtgagaatgttaaatagtacagccactctagaaaacagtttggcagtctcttataaactaaacatgcaattactatataacccagcaactgaactcttgggcatgtatcccagagaagagaaaacttatattcacacacataaaaacatgtacatgaatggtcatagcagttttgttcataatagccccaaactggaaatactctaaatgtccttcaatgagtgaatggttaaactgtggtacataaataccatggaatactactcagcaataaaaggaacaaactattgatacacacaacttcgatggatctcaaggaaattatgttgagtgaaaaggccaaacttaaaggttttatatttatgattccatttataaaacagacttgaaatgacaaaatatgagagataaagaaagaatgtgtagctgtcaagggttaggaattgggggatgggagaaggataaaagggagttgtggttattaaagaacaggaggagatccttgtgttgatggaactgttctgtatcttcactgtggttgtggatacacaaacttacatgtaatcaaactgcatagaattaaatacaattaagcttctagaagaaaacagttatctccatgacatcagggtaagcaaagatttcttaaacaggacccacacataaaaataacagtaaccatgaaagatcatttgatactttggatttcgttaagattaagaattttttttttttttagatggaatcttgctctgttgcatggactggagtgcagggacacaatctccgctcactgcaacctctgcctcccaggttcaagtgattctcctgcctcagcctcctgagtagctgagattacaggtgtgcaccaccacactcagctaatttttgtatttttagtagagaccgggtttcgccatgttggccaggctagtctcaaattcctgacctcaaggaatccacctgccttggcctcccaaagttctgggattacaggcgtgagccactgcgctggccaggcaaatattaaaatttttgataagacaatcttagagtggggaacataaattggcactgcctctacagagggaaatttaacagcaacaagagaaatgtttaaatgtttaaaatatactctttaattcaattcctaggaatttaatcctatagataaattcatacatatggaaagtgatttgcatttgtagtcattcacttcaggattattggtaaatctgtaaacaacttagtctatcatagaagactgaaaaataaattattatttattcagtcaatagaataccgttaaactgttgagaaaaaggaagctttttttttttttgagacggagtttcgttcttattgcccaggctggggttcaatggtgtggtctcggctcactgcaacctccatctcctgggttcaagcaattctcctgcctcagcctcccgtagcagggattacagatgcctgccaccacacctggctaatttttttgtatttttagtaaagacggggtttcaccatgttggccaggctggtcttgaactcctgacctcagatgatctgcctgccttggcctcccaaagtgctgggattacaggcgtgaggcacggcacctggccaaggaagctttttatgaatcagtaaggaagtgttaaagacaaaaaaaaaatttaaggtgagaaaacaattatatgtattatatattttttatttaaaaaattttaaagtttaaaaatgtttaattttaggggcagggtcctgctgtgtcatgcaggccagagtgcggtggcccaatcatagctcactgcagcctccaactcctgggctcaagcaatcctccctcctcagtctcctgagtagctaagatgacaggcgtgcaccaccattcccagctaattttttaaaaaatattttgtatgtgtggctgaggaatttacgtggaggtcagagtggaagcaagtgtgagagggtccagcagaaggaaacatggctgccaaagtgtttgagtccattggcctggccttagttgttgcaggaggcatggtgaactctgccttgttgcaggaggcatggtgaactctgccttatataatgtggatgctgggcacagagctgtcctctttgactgattctggggtacaggacattgtggtaggggaaagaactcactttctcatcccatggatacagaaaccgattacctttgtcattctcgaccacgtaaggtgccagtcatcacagtagcaaagatttacagaatgtcaataccccactgcgcatcctcttcctgcctgtccctagccagcttccttgcatcttcaccagcatgggagagggctgtgatgagcctgtgctgccatccatcactacagacatccttaagcaggtggtggttcgctttgaggctgcagaagcaatcacccagagagaggtggtctccaggcaggtgaaggatgaccttatggagcagtagccacattttatttagctcatgctggatgacacctcctcgacacatctgacctttgggaaggagttcacagaagcagtggaagccaaacaggtggctcagcaggaagcagagagggccagatttgtggtggaaaaggctgggcagcagaaaaaggcaaccatgatatctgctgagggcgactccaaggcagcggagctgaccgccacctcactggccactgtggggacttgcctgatggagccatgccagccagaagccactggggataccacgtgccagctcttatgctcctgaggcggggcagtacctgctcctccagctgccccagtgaggccccacctgcctgcatctatgcgggccaactgggccacagccccgatgattccaaacaccgccttccttctctccctaccccaggaatcactgtgaaatttcatgattcgcttaaagtgaaggaaatgaaagtaaattacttcaggctgggagcagtggctcacgcctgtaatcccagcattttgggaggctgaggtggtagatcacttgaggtctggaactcgagaccaacctggccaacatggtactacaaatacaaaaattagctgggcgtagtatgcctgtagtcccagctactcgggaggctgaggcaggagaatcgcttgaacctgggaggcagaggttgcagtaagctgagattgcaccactgcactcctgggcgacagagcgagactccatcaaaaaaataaaaggacagggtcttgttgtgttgcccaagccaatcttgaactcctgacctcaagtgatcctcctgcctcggcctcccaaagtactgagattataggacttagccagacatacatacatacatatatataatatatatatcataatatttatatatacacaaacatacacatatatacaccacacatttttaaaggtaaaaaagaattgtacatatatatatacactttatatgtatatatacatttatagctgaaaatgcattgtatttgtatatatacatatacttatatatgcatatatgtaaatatgtaaaatataaaattttgattaaaaggaagacataagtggttaaaaaaaaacacacaaaaaccaagcctatccccttacttctagactgcttctcttcacttcatactgtgtatcacttggtcaattcctaaaatgccagccttcatcagtttgttgttaaaatgtaaaattgtgattcagtagattctgggcgagattggtgggattgggatctgaggttctgtgtttcctttttttttttttttttttggaggcagggtcttgctctgctgctcaggctggagagcatagtggtgcaatcacacctcactgcagcctcaacctaccctcccacctcagcctcccgggtagctgggactataggcaagtgccaccatgctccgctattttttgtagaggtggagtttctttcaccatattgcccaggctagtcttgaactcttgagctcaggtgatctgcctgcctagggcctcttgtggattacaggtgcgagccaccatgcttggctggttctccaattctaacagctcctacgtgatgcttcttttgagtaggaaagagctagaatgtacagcctttgaattcacatcacatttactatatgcaactttgttttataatgtgtgaataccttgcctactcacttgtattttaaattccaagaaagcttctagcagcacttgaacagctgattattctttccttctcaaaacattttttctttctgcttccttgacattacagtcccctacttttgcttgtacctcaatggcctcacctttcagtctttgcatgtgcttaataagtaagtaaatctttatgtagactcattacctattattaagtataatatatactgaagtgaacaccatgccatagctcctgaatggttctagagagcctttctcagactgtgtccctcaataagagtttacatattttgtaggtaggacaatagccttatgaatgaagtcttggtgatgcagccagaaactcagagactctaagtcaaatactcattggttagatcaaatataattttgccatagtctgaggattacagcaggtcacattatgctaatcttaaagtatgtgttgggctgaaccttgccatatgtattttttaaaagactttattttttagagcagttttggagcagcaaaattaagaggacagagatttccaacatatcccctgccctcctcacaatatattttacacatgaatagttaggatattttcagctgtatatagtgagacctaattcacaccagctaaaacaatatggaattttattatctcacaaaacaaagttcagtggttagggtgtctagagccacgctctggctccatttctatgctattttctcagctctgccttcctgagggtgtagggttcatccttaaatggctttcttcttggccacatgatggctgccagcagcagtagtgataacatgtacccttcttcaagtataggtgaagagaaaggaaacctctcacctactattgaatgtaagtctttcccttcagtttgattggtcaatgtaggttctctccctgaccagtaatagtcaccgtaagaatgctatgtgctgattgccttaagcctagttctggagcaagtaacaaacattggcatggaagtaggaataccatgttttcactagtcctaataaaacagctagggctagggataaggtgagcttcaaagaattatatagaattcatggaagagaggaggaatgttaaacaaaagcaaagttctttaggaaggagaaggggaaaaataaattctgaaattaactaagttatattactatgctaatagtaattgtataatagcttttataataaattttttgcttgttctctatatagctagcctcagagtgagatgtacactgatatatttgatagtgaaaccttaaatacaagtgccaagaagtatgagcacataattcataaattaagacacagagtcttaatttgtgaaaaagtaccattacatccagcttcctgggttttaccattgaactcaacagatattctgcctatttccatgtttccattaacatagccccaaattatgtgaaaactgacacgtatgcccaattgattattaagacatggagaaattctactttctttttctcttttttttttttttttttttgagtcagagtcttgctctgttgcccaggctggagtgcaatggtgcaatcttggctcactgcaacctctacctcccagattcaaatgatccttctgcctcagcctcctgagtagctgggattacaggaggatgccaccacacccagctaatgtatttttggtagagacggggttccactatgttggccaggctggtctcgaactcctgacctcaggtgatctgcccacctcggccttccaaagtgctgggattacaggcgtgagctatggtgccctgccgaagaaatcctacttctctgcctaaacttgagtagaggtttctaaagtttaaaatagaatttaaacctcgtccccatcctcctttgcttagatatcatactatcaaggacttgtttatgtaatagattttatattgaaggtattcaagcagaagctatactaatgttattgatggtactggtacatctgataaatgactggtctggagaatgcttcctaggcctagctgattgagagaataactcagaagttttaaacaatacagattccatatcctgatcatacttaatcagaatctctgaagatggagccaaagatatgtatctctcagaagcactactaataattttttacagccaatccaggaccagctcctgggtaattatttaggaatctctggactaaattttctaaaagacccatttaaatatacaattttaataacttttgacagtggaaatagcattgcactagaaattaggtgactgaaattctagtgccagctctgctattggttactttgatgacaggcaagttggtttaccctgtggagcctcagttttcccttctgtaaaattagggatgtctaaagtcccttccagctccaaactcagtcaattttacttgtttgggcattctgaggaaccaagagttgattataaagattctaatttctaatacctctagctgtttttaagggcacataaagagcttacatagacactgccatctcagaagaaaggttcaagatggggtccatagaactcttaagagtgctatcattgttttggtaactttgaacaaattttcctataaaaactggggacaaaatactataaatatgtgaacaaaagtctctttgttaccagtggttaatgggtatccctgcagctaccacctgaaacagttttggctctgactccagaaccaaactttctggcctttaactgtttggtagggtgatataattcatgttatacagcatactggtccagcttttagaatatatatatatatatatatatatattttttttttttttttttttttttttgagatggagtttagctcttgttgcccaggctggagtgcaatggcacaatctcggctcactgcaacctctgcctcctgggttcaagcaattctcctgcctcagcctcctgagtagctgggattacaggtgcccgcaaccacgcccaactaatttttgtatttttagtagagatggggtttcaccatgttaggctggtctggaactcctgacctcaggtgatccccccgcctcgacctcccaaagtgctgggattataggcgtgagccacaatgcctggatgtagtttgttggttggtttgttaagaactaattgttatggtaagatttgccttagcctgggcatggtggctcatgcctataatcccagcactttgggagaataagaccagaggatccttgagtccaggagttcgagaccagcctgggcaatatagtgagaccctgtccctacaaaaaattttaaaaagttagctgggtgtggtggcgtgcgccggtagtcccagctactcaggaggctgaggtgggaggatcatttgagcccacgaggttgaggctgcaatgaaccatgatcacaccactgcactccagcctgggagacagagtgaggccctgtttcaaaaattaaataaataaaacaaaataaaattatcctatggtccacttctcttctgattatcttactgtaattaactctagtttgtttcctgactcataatttccctctccacaccatgcccttttctctcttctctgcttccatacacaaattcaacttcttcaaccccttgttttacacatttttagtgacactcttgcccgtgatgttatcatttaaaaactttatttaggctgggtgcagttgctcacatctgtaatcccagcactttggaaggctgaggtgtgcggatcacctgaggtcaagagttcgaaaccagcctggccagcatggtgaaatcctgtctctactaaaaatacaaaaattagtccggcatggtggtgggctcctgtaatcccagctactcaggaggctgaggcaggagaatcacttgaacccaggaggcggaagttgcagtgagcctagatcacaccattgcactccagcctaggcgacggaacgagactccatctaaaaaaaaaaaaaaaaaaaacaaaactccaaaaaaactttatttacactgagtaacaaatagctagtgtttattgaatgcttaccatgcgccaggcactgtattaagcattttacatacaatatatcaattgttatacttttattttgagtactattagatcctccactatacagataagacccagaaatattgagtaacttgcccaaaattacataactagttaggtggtgacgtaggatttgaaatcaagcatttagactccagagcctctactctattgtctcctataaaagcaaggattaaagaaaagtaggccaggcgtggtggctgatgcctgtaatcccagcactttgggaggccgaggtgggtgggtcacgaggtcaagagctcgagaccatcctggccaacatgatgaaaccccgtctctactaaaaacataaaaattagctgggtgtggtggtgggtgcctgtagtcccacctactcgggaggctgaggcaggagaatcacttgaacccgggaggcgggggttgcagtgagctgagattgtgccactgcactctagcctggccacagagtgagactccatctcaaaaaaaaaaaaaaaaaaaaaaaaaaagaaaaaggaaagtgtactacactatgatgaaagagatgagagttttgtgtttttttgatagtaactagctaatatatcactatggacaggtcataattgttctgattttctcattcatatataagttgaagtagaaccaactactgtgtcataatactctgtgattctgttatgtgaaaagtgtatcttttgatcttttgtctcctgatatgaaaggactttggcatttcagccccttctcctatattttcatatttattctagcactagcttacattctaacagtgaaacacaggtaaatatgtattttatgtgtgttctgtttctatttctgtaaagcaaaatgtatctgagtagcataaaatttttagaaaatttcaagtctcatccctatttttctggtacttttagatctgatatcttgatgatggcagaagtggcttaaagttggaaaattattgtggttttgcccaacgtggcaaatcagtgctttttattttgtatataatgtgtaattttcacagctataacaattggttattatatattgatctttgaaaaagcaatgtattccagtagcatttttttaaacagggtcttgctctgtcacccaggctgtagttcagtggtgtgattgtaactcactgtatcctcaatctcccaggctcaagtgatcctcccacctcagcctcttgaatagctgggaccacagtgagcaccactttttaaattttttgtagagatggggtctcaatatattgaccaggctggtctcaaactcctgggttcaagcaatcctcctgcatcagcctcccaaagtgctgggattacagtgtgaaccatcatgccccactagtattttcttttgtgttcctatctatttcttgaattcatgtttccttatgtttatcaagcctagtttcttttacttttaggaattaaggctgaattaggacttttaatgactcccatactaaaacttcttatccttttaaagctgaaatacattgggaggatcagcaaggtcagagaaagagagggtaggtggggataagagagtaaagcccttttgcaaataggcatacttacacagactgaaagcaggcccttcaatctctctgcaagtatttaatctctctacaaaaattaaagtgtgtttgcttgttatctttttcattctttggaaaacattttagctatcgttactattattttgacattttatatttgccttttttttggaggagtcagtactgaagggggaatttaacttttaaaatggccacttatacataactagcatagaagcagaagaaaatataggtaagcaagaaaagaaagatcattttaattggaatgtgatggtggcacaactctgtaaatgtattaaaactcattgaatcatatacttaaaatggatgaatttgcctcttttttctttgttcaaccacatacgataaccatctttccaggtcaattcatattccacaatatcattttaaatggggacacaattttcgattttatattatgtaatttgttttaatttttttttttttttttgagacggagtcttgctctgtcgcccaggcaggagtgccgtggtgcgatcttggctcactgcaagctctgcctcccaggttcaagcaattctcctgcctcagcctcccgagtagctgggactacaggtgcatgccaccacgcccggataattttttgtattttcagtagtgatggggtttcaccatgttagccaggatggtctcgatctcctgacctcatgatccgcctgccttggcctcccaaagtgttgggattacaggcgtgagccaccacgctcggccataatttgtttaaccaattgattccctgaacatttttgcagctaaagtttggtacaaatttttttaggttaaattactaaaagaattattgctagatcatagggcatgctcatttaaaggtttttcttacaaattgccctctaaaaaaactaccaatttatactcctataagtagtcattctgtccttgcacttctcccttcgaaactcagtattagtattttataaagtctctattattctgaaaggtagaaatgatagcttgttatcaatttccatttcaattactaataaagttgaacttttcgtcatttattagacatttgtatttcagtttatgttctctgtccctctctccaaaacactagcatgtgtacatgtgtttcttattcattcatatgacttttatacattaaggataaataacttcatgtcatatattttgtaagtatttttccagtttgtatcttttatttatgttgtttttgcagaagtatcaaattatatggtcatacctatcaatcttttgctttatagatattgcctttggtgctatccttgataaggccttccccactctcaaatatttaaatattcaacaatatttctcccactaattttatgttttctttcttcagacctttatgtagattttatttttatatataacataggacaaggatataacttggtaaaacgaatggggagacaaatttttaccttatttattgcatgtcttctaaatatcaaaaactgtgttatatatggtttgtagtaataaacacagcagggatgttctcatccttatgtaatttaccaactcagagagacaacatactgtttaagtgcaaatttgataaatgctataaagaagtgctaagttctatggtagtgtatagtatgtggaatctatcaactgttcaggtacttattgaacagttgatctttaaaaggagatggtttggtggaagtggaggagaattcaattaaaaaacaacagggcacagtggtgtacgtttgtaatcccagctactcaggaggctgaggtggaagtactgcttaaacccaggagttagagaccagcttgggcagcatagggagacctcattttttggggggagggggaatacccaaaaaacccaaccatacacacacaaaaccaaccaaacaaaaaacaacaatgaacatttattatttcagagtatccctgggtcagaatctgggtgtggcttagctgggttctctgtttcaggatctctcgcaaagatgcaaacaaaagtcttgcccagggctgcgatcgcatctgcaggaagattcacttccaagtttgcttacatggttgttggcagaatgcagctcctcataggctgttaagccaaggctttcagttctttggtaggaattcagttcctcacaggttttttggtggctggagatctcctttagttccttggcatataggtcagaataatttatttttgtcctagggtgggtacttaagctttgataaaactgatttataatgtctttatggagtaaaaattagcacagcattcatgttcttagctctatattcaagaataaaataagtgtgtatattctgtgaatattctggttggtatacatttttggcctgtatgtaaattaatatgtgggtgacttaaacattcacagagaattaattatatattgcaaaggacaaacacataattctgttcaagataggaatgtcaagaaaactttaagatgattttgtcttttaatcacatcatggttataatttcaaatgatttttcattccctcctttccttcccatcacacagactatactgtaaatatactctctgaagttgcacaacgtgacaagcttaagcttagccacacaagtatgtgcatatacaattattttattttttgatctgatgctgacagtgctgtgcgttttacctgaactcagaaaatttaatttctaaattataatatatggttagatatttactaaaatcctgaaactagaattttactcccaatcttagaccttgcaaatggtaactctagtttagtgtacacattttcaacatgggcaatattactccccaagaggaaaaaattgtttttttgggagggtatgaaaaaaagtatgttttatatataaagcatagatacacatacagtccattaaagcatatacagtgtatctatggtgttaaaattttacagtggggtgctgaataggaaaaacaggtctaaaagggttccataagggggctgataatggaaataaaagttgagaaacatggccctagtgctaagcttaacagacagctgtttgacgaaccatctggcattagatttttttcctgcatgatttcctgtattagaatataagcttcttaaggacagaaaatgtaatctgatttgtattttcaataatagctaacacaatagttacgttcaactgcattcagtatatgtatatttaattgaattaatatggagtacatcttcccctacttgcactcatcctattagctctataaaatctaaatgtaatgaccaaaattagtctagtaaagcacaacctatcacaatctccctcacaaaaatcctagtaaaataatgacaaattttattcaaagaatggaaaatcttcaaagtagcataagagaaggagtacagactagagacagagagatgaatcagggctttgatttccacctcttatcatttgcaagccgaggagccttgagccaagttatgtaaagagaaagtgaaagaggataaaaaagaataaaaaagggacctttctaggggaagggtacaagaagggacaatggcatttctagcaggtttttgttttgttttgagacagggtctcgctctgtctccaggctggagtgcagtggtgcgatcttggctcactgcaacctctgcctcccgggttcaagcgattcttgtgcctcagccctccccccgagtagctgtgattacaggcaagtgccactaggtttggctaattttttgtattttcagtagagacagggtttcgccatgttggccgggctggtctcaaactcctagcctcatgtgattcgcctgcctcggctcccaaagtgctgggattacaagcatgagccgccgtgcctggccctaacagtcttatatacacccaaaatttcaggcatgctgaatttctggcagttccccaaataatgcatggctcaaatatgccgtatttcacacttacatattttatatatacattcacattcctcttcccagaacatcatttatttgtcctccaatactcagctcaggtcacactttttttttttttggatggagtcttgctctgttgcccaggctagagtgcagtggcacgatcctggctcactgcaaactctgcctcccaggttcacgccattctcctgcctcagcctcccaagtagctgggactacaggcgcccgccaccacacctggctaatttaaaaaaatatatattttagtagagacggggtttcaccgtgttagccaggatggtctcgatatcctgacctcgtgatccgcccaccttggcctcccaaagtgctgggattacaggcgtgagccaccatgcttggccagctcaggccacattttccctaggaaggcctccatgacacgcttgtgtgccttctacactgagttagatacatatattcttgcttccctaacattcagatcatacttctactatagtacttataattaatggtttacatgtctgcttctcttactagcctgagaacttcttgagagctgaaatggttttatttatttatcttttcagacagagtctcgttctgttgtccaggctggagtgcaatggcgggatctcggctcactgcaacctccgcctcctgggttcaagtgattctcctgcctcagcatcctgagcagctggtttacaggcgcatgccagcacacctggctaatttttttttttttttttgcatttttaatagagacaggatttcaccgtctggccaggctggtctcaaactcccaacctcaggcgatccgctcgcctcggcctcccaatgtgctggaattacagacaggcgtgagccaccgcgcctggcctatttatcttcttaacctcaacatctagcacagtgcctgacatgttagtgaacaactgacttgttgaattaactaataaaaatacaggcatacaagaagagcacagtagcattttcagcaatttgacaaatgaatattgctttgttttcttcaaagggccactactttaaaattgaataatcatctttgtatatagtcagacctaaaacaaagctctgtacacttcctgtgtcaaataataataatgtaagtcctttacactaactcatttcatcattgcaatccaatgaggaaaaccttattatttttcctttttttttcctcagatgaggaaacaggcttgtaagaggtaaactaatttgcctaaggtcacatatttaataagtagggtttctagctctggcatgtatggtgctaactaccacactattgtgcctctcaaagtcagctgagtaagaatactcactgttgcacaatatctcatccctctgtctgaccctctccacctgcaatctcccatatacactcacttaggagaaacaaaggctcacggctcatacatgcagcttgtgatttagaaaaaaaatgtgcccacatatgctcggctttgcttaatgtaaacaaatatactaatcaatatggtataaacctccaggactattctgttttaataacatgtagatacaatgtaatgattttaattactttattgtcctgtcaaattctttaaaatgggaacttgaggccgggtgcggtggctcacgcctgtaattccagcactttgggaggacaaggtgggcggatcacctgaggtcgggagtttgagaccagcctgaccaacatggagaaaccccatctctactaaaaatacaaaattagctagacatagtggcgcatgcctgtaatcccagctactcaggaggctgaggcaggagaattgcttcaacccgggaagcagaggttgtggtgagctgagatcgcgccattgccctccagcctggacaacagcgaaactgaaacttcacctcaaaataacaaaaaaaaaaggaacttggtatgctgctccagcaatttaaatgtgtcaatccacgtatccaatgttaaattatcttttccagaaagcaaaatgtgaagcggcttataaagacttcttgtcaagtatcacaagctctccattattactttactaaagatgtctgtgatgccactttgcaaaataactgtagggagtggcatttggttcctggggtggaagaggtgactatgcctactaaatcatggtattgtctcaaatgaaaccaaaagaaccaaaaaaccaagagagaaaacaaaaagacaaaaaaagaaagctttttcatttctgaaaactttggggctgtgtggtcctatcaggtgctgctatttctgggtttactattactacaatcttcaagtcctaaagatttttgcttcctgttgcagtcctttattcattcataaccaagctgcattgtaccatttgtatccaatttagctggattccaacatcaatcctatcttgccatgaagtattaaaggctgagttaccactggggatgtgggaggtaaaatgagcatttgccctagagaaatcctagataaggagtgccacggagaacatgcatatcagaccccctcttccttctgctccacacaaccttcaagttttcatgaacacctagaagaattaacaggcaagaacaccagtgttgatttaatgttggcaagattcaacatattttgaggtaagaatacaatactacatgtctattattttcagacatttaggtttatactaattcataaactttaggtttatattaatttattccagcattaacaaaagcttggaagtttgttgggaatgggcattacatagatgactacatgttctaggcatcaagcaccatattagaaatgatacgaaaaaaatagtagttttgaagcacatgaattagtttgtgggaaagagtaggtggaaaggagatcaggcagaggcaacagcagttacaaaggcaggacgcataagaaagtctagcaattatgcttttgtagaatatgccagtctagtgacttctatctttttttccctagctaggatttgaacctatctttttttataacttttttttttttttttgagatcgggacttgctatgttgctcaggctagtcttgaacaccttggttcaagcaaccctcctgtcacagcctctcaagtaactgggattacaggcacatggcaccatgaccaagaactcctttagcactaccatttgtgccagtcttcttggcttgtgacatctcttcaactgtgcacttatcattttttaaattaaccttttaatttatctccttccctaaattataatctctctttgtttctccagaatgccaagaaaggtgctttgcattgagtagacactaataagtaactattgattgcctgaccaaaaaaatcatggcttatgtactgtaagtcttcattaagaatgctaagattaagtcaggtgcagtggctcacgcctgtagtcccaacactttgggaggccaaggtggatcacctcaggtcaagagtttgagagcagcctggccaacatggtgaaaccctgtgtctactaaaaatacataaaattagtcgggcgtggtggtgggtgcctgtaatcccaactacttgagaggctgaggcaagagaattgcttgaacctgagaagtggaggttgcaatgagccgagattgcgcaattgcgctccagcctgggcgacagggcgagcctctgtctcaaacaacaacaacaacaacaaaaaaaagaatgctaagattatatttataagaataaagtagaacgttgtgaacagaagataacacgtctattcgctacgctacttttattacctatttccaggaggaacaaatactacatacagtcaatgtttatggctgtcaatctagaaagcagtaggattgacagcaattactcccttataaaaatacaaagacaaattttagaataagaataagatcttattataatcactgagaattaatatggaaaaaaactggacttgaactctgaaaacttggatctgaatcaaggttctgccacttgttgtgtactttggtaaattacttccacctttgagcttttttctcatctataaaatgaagttaagacttccaacttcacaggatcataaagaagaaattaaaaatgcatatgcagccgggggcggtggctcacacctgtaatcccagcactttgggaggccgaggcgggtggatcacgaggtcaggagatcaagaccatactaaacatacaaaaggtcacgaggtcaggagatcgagaccatactaaacatacaaaaaattagccgggtgtggtggcgggtgcctgtagttccagctactcgggaggctgaggcaggagaatggtgtgaacctgggaggcggagcttgcagtaagccaagatccgccactgcactccagcctgggcgacagagcaagtctcaaaaaaaaaaaaaaaaaaaatgcatatgcatctagtgtggcatctagtatagactcaataatatatttgctcactttttgcccattcatccatttaaatacatccataaagcaacaaaataaactagagatattgtgaactacagagaaatgtttgttttgcaaactttagctacaaaaatacttttccttcaagtccttaagtcattacgataaatatacgttcactttttggaaggtcatcatatgttactttttgttgtagtgtaagcacacatttaaggccaaataaatgtatattgcaatcatggggcacatagacactatggttttgtacatttgtccaattgtatgatagtatatactctagtttcagcattatcttttttttttcttttttgagatggagtcttgctctgtcgcccaggctggagtgcagtggcatgatctcggctcactgcaacctctgcctcctgggttcaagcaattctcctgcctcagcctcccgagtagctgggattacaggtgtctaccaccacgcccgactaattttttggtatttttagtagagacggggtttcaccattttggccaggctggtttcaaactcctgacctcaagtggtctgcccgctttggccacccaaagtgctaggattacaggcatgagccactgtgcctgccctctagttccagcattatcttatcacacattagataattacttgtataaaagctcaggctcaataataaagtctatagaccctgtacaataggcccctttgtatctgcagtttccacatccacagattcaaccaaccatggagtgaaaatattaaaaaaaaaaaaaaacataaaaagtaagaatacggcaattaaaaaaatcaaatgtaacaatacaatataaccaccatttacaaagcatttacattgcactaggggttacaagtaatctagagatgatttaaagtgcttgagaggatgtacgtaggttatatgcaaatagcatgccattttatataaggaacttgagcaaccatggattttcttatctgttggggtactggaaccaatctcctgcagatatcaagggacaactgtatttctagaataaaggtgaggtagcgaatatcttttatttttattattattttttgaaacagggccttgctctgtcacccaggctggagtacagtggcatgatcatagctcactgcagcctcaaattcctggaggatcaatggatcctcctaccttagcctcctgagtagctgggagtacatgcatgcaccaccatgcttggctcattttttcttttttttttttttgagatagggtcttgctatgttgcccaggttggccttgaactcctacgctcaagtgattctcccatcttggcctcccatagtgctaggattacaggcatgagccactgcactcagccctcgctaatttgcttattttttattcttttgtagaggcagggtgtcactatgttgcccaagctggtctaaaactcctagcctcacgtaattgtcccaccttggtcttccaaagtgctgggattacaggcatgagtcactgtaccaggatggggagatcgtaaagaaatggctgcagttaagaatcttgggttctacttttggttgtcactatctctaccagacgtctaatgtggcaggtaacttcagtttctctataccttattattattattaacacttagaactggtgtgatatgatctctcaataatgctgtaatacttcattggtatctatagcaaaatttgaaatacatagatgtttttacagaaatgcaaagtactcagcttatcagtgtctctttttgtgctttgataaaaatttaatttctttacctccttcctggtaaaacacaggaacacctaaaacattaaaaaacaaaaaacaggccaggtgtggtggctcacgcctgtaatctcagcactttgggaggctgaggcgggcggatcacaaggtcaggagatttagaccatcctggctacatggtgaaactctgtctctactaaaaatacaaaaaattagctgggcgtggtggcacgcacctgtagtcccagctacttgggaggctgaagcaggagaatcacttgaacccaggaggtggaggttgcagtgagccgagattgcaccactgcactccagtctgggcgacagagcgagactccgtctcaaaacgaacaaacaaacgaaacaatagaaaaacaggccaggcgcagtggctcacgcctgtaatcccagcacttcgggaggccaaggcaagtggatcacttgaggtcaggagttcgagaacagcctggccaacatggtgaaaccccatctctactaagaatacaaaaaattggccgggcgtagtggcgcatgcctgtaatcccagctatgcggaaggctcagacagaagaatcacttgaactgggaggcagaggttgcagtgggccgagatcatgccagtgcactccagcttgggcaatagagtgagactttgtttccaccccccccccaccaaaaaaagacaaaacaaaacaaacaaaaacaaaaagtgctgcattaaaactgattttataaacaaaatgacaaaaagcaatttcttctcacttgattttagagacaattgcttacatataagaatttttggtcagatgccctgtagggtgaccaaaccatcccagcttgcctgggacttcccagtttgggtactgaaaactccatgtcccaggaaacccctgtcctgagccaactggaacagttggtacagttggcttttccatagcttacacttctattatctgcccttagaaaaattccagtgctactgtaatttatatttatctgaaaagcacctgcatagtcttcctgttggtattcagtacataatcatttggttagcatataaatatttatggaattttgtcccatgagtagatattttataaatgtatacgaatatttttttaccttactaggacttggggacaatgggagtgccaaattaccaacaatgattatctcggcaccaaaaaggtattaatttgtgtattttctttttcaagaaccttttcctgttgttgtttagagactactgtgcttctagctagtaatcaccatcgctgggaaaacaataacacaggcaatacctttaagaacaagtcattaaaaaacaatacaaaataatgtatgtgggtcatcccttggccaatgtggggccagagagaagttgttctactggttttccttaaatagcaccataacctaacctgaatctaagatggtttccaaaatatgtatagaacgaatgttaactaattaattctataaaaatatgtatagaatgaaagctaattaaccatcaaaccatggttataatggtttatccatggataggagacccagaaattcagaagcactgtaatacttttcatgatattaataaaaaatgaagtcatgagatcatggaaaaggtttctgagaaaaaaatcagaccaattttcttccctagaaaatggggatgacacaggctgtgtacatataagcataattaaaataaaactgattaggctgggtgtggtggctcacgactataatcccagcactttgggtggccgaggtgggaggatcatgaggtcaggaggtcgagaccagcctgccaacatggtaaaacccgtctctactaaaaatacaaaaattagccaggcatggtggtgcgtgcctgtagtcccagctactcaggaggttgaggtaggagaattgcctgaacccgggaggcagaggttgcagtgagccgaaattgctccactgtgctccagcctgggcgacagagtgagactccgtctcaaaacaaacaaacaaacaaataaacaaaactgattaaaagattataaaggtgacttatgacactttttaaaagctctgattttgtgagtacttagctatgtgccaggtactgtgtcaaatgctttaaatacataatttcatttgatactcacaaataatcctatgagaacaggaattatgatcctccaaagtaaacctctaaaagagaggcttagtaatttgcttaaggttacagacagcaacggggcaggggggtgcataggcaaattcagatccatctgcttcaataacttttatcctcttcacctttatcctatgccgcttctaaacattgctggtgtaaactctggtaaaattgtatctccagctctaatttttcctgaccttcagtcttgtatcttagtttatggaactgcctactcaacacctctaccctgatgtctaacgagcacctcaaataacatgtttcagtgagtgatgccaccattcacccagtcgctcaagctccaaatacagtaggcatccttgtttcctccatcaaacccactgtcaagccaccagcaaatattttggctcttctttcaaattctatctcaatctgaccacttcttatcacctccactgccacaaccctagttcaggctattatctacttacctggactactgagatagcctcataattgctttgttttcgtagtccattcaccataaagcagtcagttatctttttaaaaacacagatcatatagtttcactcttctgcttaaaactcgttaataattgccactggaataatgtaaacttcttaagatgacctacaaggcccctactggccccctaccttgatctgctttctctgactttatcccttaacaccctcttctttgctcagcatgtctcaagtcacattggtcctgatattttcaaattcctctgtgactaaaagtcacatgttttgagaagatgtgaaagggcagggctgaagtttgaggaaactgcaaaggtgtgaaagagttgtcgagagtgggagaacaatccagaaaaatttaataggattgctgggaattattgaaggttgagttgtgcttggtgattgaaattaagtaggctgggtgtagtggctcacacctgtaatcctagcattttgggaggccaaggtgggaggattgcttgaggccaggagttccagaccagtctgagcaacatagtgagatgtatctgtaaaaaaaaataaaaaattagccaggtatggtggtgtgcacctgtagtaccagcaactcaggaggctgaagtgggaggatcacttgagcccgggacattgagccttcagtggtgatcgcaccactgcattccagcctgggtgccagagcaagagtgtctccaaaaaaaaaaaaaaaaagaagaaatgtagtaatagaatacagatggctatgcacatttctctaatagtggtcagctgctccatttatcaaagtggagactatggatggtagggttcattcaagataggggtacaatgaaaagaaaggtgaggcaaaggagtttagggtactgacgagtgttactgaatttttctgtaggtaatatcacaatggagacggggtggacagaagtgttccttgtgtccatggcttgccttagttgtggcagcaatctagaattgctaaatagaaacactgaatcaaagaacctagacctggctgggcgctgtggcttatgcctgttatcacagcactttgggaggccgaggcaggtggatcacctgaagtcaggaattcgagaccagcctggccaatatggtgaaaccccatctctactaaaaatacaaaaattagcctggggtggtggcatgcgcctgtagtcccagctactcaggaggctgagacaggagaatcgcttgaacctgggaggcagaggctgcagtgagctgagatcaccactgtactccaatctgggcaacagagcgagactccgtctcaagaaaaaaacaaacaacaacaacaacaacaaaaacctagactaccagtattgaggttaaatgctttactttgtaaatcctgaggttaagaaatataattatcggtattttaaaacttacaaaatggacaaattggaagaggctttttaacattataatggaatttttcacttttcaaaatcaatttccaaagggaacctataggttgaacagtaagatttatcaacaaatcaggggttttgattttaaaaggttttcaatctggccaattcttcagattatctcaagagggagccttcttatgcctcttcttccttcataacacttctctggctcgcatgtcctgtttgcaaagatttaagcccactcttaggcataaaatgctcttaactgacatgacccctgactaacttgcctaatattttgccatgtaccctccatgcactttaagctccccaaactattacttacttgacaccttctgcgcttttgcttgttctctgcggctagaccatcttccctaccttctctgttgaactcctagccattcatcaacactcagctcacatagcacactttcagatgagattcaagcattatctctctggctacatttggcccttgtagatatttctattattgcctgtattttgttgaagcattcatgtcttttatgtactacatagtacataatatatctacattacaaagcatttttatgattcatgttttggggcatccagcggttaaaatagggcaagggttatgtggtcttggccaggtcccttttcctttctgagcttcaggttcctcaggtataaaatgggtactatggctccgtgaagatgagacagaatatatgtaaagcccttacacagtgctcaattcatgaaaatcatcgctgtttacattgtttagggccctcaagaggcgctcttgtcagcggggtggaggaaatgcctctttaaaatgacgtcattataggagacttaaaaaccactgcacgtctgtacaagtggacagaatcacacagctacctaaagtgggttcacctgtcatacagtttagaggttccacttacaacaggtttccatcagtagccaaagcaacagaaattttagcttaacggctgagggcttccgggattaccgcagggcgggcgggaagcgcctttccgctccggagggaaggccgcgtccccaagggactgcctaagtgggctggatccctatggcctgcggcagacaccaccacgtaggcggtccaggggtccctctctcggtgactggtgaccaggaggccgcaatctcttcacataaaaggtctacgggtttccgctcggccctcacagcggcagcggatcgaaccaggaaagcaattcccgctcggctcccctcgggtcccaggcccaggaaggccgggccgtggggtctccccgggctccacgcaggggcggtggggcggggcgcagtgacgcaaagaggagtgacgcgacgacgcagcgcgacgcggtgacgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccaggtgagggtggccgccgcgccagctggaccgggcccgacgggggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattctcttttgcccattgcccctctttgggatatttatctcttactggtttgtaagacttctttctattaatagaggttggaaatagcagttatctaggtttttaatgttggtttgataaacactgaattttacttagtttgcattagagagcttactgttaactcttaaacatttaaattccctgttctcagttctaattttcagtgtgaaatcaggtaagatacatttgcaggtgaaaaagtttgaaatgtaaaaagataaccaaattaatttaatatttccttgggaatttgattactttttctgggagaggagttctgggcaacaacataaatactgttatttgtggatatttgcaggttaggtttggtcttcaaataagtcaacattattttctttcagaaaacttggttttctggctttctataatttcccaattaacatttaaataaaagaccaaattaaacaattaaactttatttaatttggtcttttgtttaaatgctttgtggctacctagcttaccttttcagcttttaaggaaaaaaaaaatcagagttttttattttgttttgtttggagacagcctcactctgtcacccaggctgtagtgcagtcgcgtgatctcagcttactgcaacctctccctcccaggttcaagagattccccttgcctcagcttccccccctaccccagtatctgggattacaggcacctgccaccaggcccagctaattcttgtgttacagggtttccccatgttcatcatgctggtactgaactcctggcctcaagtgatctgcccttctcggcctcccaaagtgctgggattacaggtgtgagccaccatgcctggccagggtgttttttgttatttgtttattttgagacagagtttcattctgctgcccaggttggagtgcagtggcgtgatctcagctcactgcaacctccgcctcttgggttcaagcaattctcctgcctgagcctcccgagtagctgggattacaggtgtgcaccaccacacccagctactttttgtattttttagtagagagggggtttcaccatgttggccaggctggtcttgaactcctgaacccaggtgatccacacagctgggcctcccaaagtgctgggattacagtcttgagccaccgcgcccagcctaaaaagtagttttctaatgtaactatataagtagctaggtaatttattaaaagaaccctgttcaattctgcagttgggagtatttaaacttgccattttgtttttccacaacagtgttcagcaaatgttgattgtgctttctaagtatgccaggcattatgttaagcagaggatatgctccttgcctaaggagcatatagggatagggaatatggaggtccttgaactccacttccagagattcttactcattaatgaagtctgaggtgaaaccttagcatctctgtattttagccttctagtgataaccaaaccactggaatagtgatagttaatccactgtcacgattttgactcaggcagggtgagtagagtgagaagagcagcagctcttaggggcacagattgggtatacctaatcaaaaaatcagaaatgctctgaaatcactttgtgttgttgcccagactgaagtgcaatggcaagatcatagctcactgcaacctcaacttcctgagctaaagtgattctcccgcctcagcctcctgagtagctaggactataggtgtgtggcaccactcctagctaattttttttcttttttgtagagacacagggtcttgctctgttgcccaggccagtctcaaactcctggcctcaagcgctccttgaacctcagcctctcaaaatggtaggcctggaaatccaaaactttttgagcaccgttgtgatgctcaaaggaaatgctcactgcagcattttggatttcggattttcagattagggatgttgattgtaagtataattaaatattccaaatctgaaaaacttctggtctcaagtattttggataaggaatactcaacctgtaccatatttagagtgtgtgccgagaggaatatggacctgggactattgaatgtgagtggtcagaggaggtataaaaaacagtggataggtatcttgcttttataagatctgttatgctaaataactttttttttttttggagacggagtcttgctctgttgccaggctggagagcagtggtggcgtgatcttggctcagtgcaacctctgcctcctgggttcaagcgattctcctgcctcagcctcctgagaagctgggactacaggtgcgcgccaccacacccaactaatttttgtatttttagtagagactgggtttcaccatgttggtcagatggtctcaacctcttgacctcgtgatccgcctgccttggcctcccaaagtgctgggattacaggcgtgagccaccgtgcccagccaaataactcattttaaagaaaaaaatatctaagccttactgaagaaattttctgttggctgttggttcgaaagctgtatttcacttatttaattaagagatttaattaaagaacctcaagttgaggttgcaagcctaaactaaggaagacagtgtactattctttttttttttttcgtttgagacggagtctcgctttgttgcccaggctggagtgcggtggtgcgatctcggctcaccgcaagctccgcctcctgggttcacgccattcttctgcctcagcctcccgagtagctgggactacaggcagccgctaccatgcctggctaatttttttgtattttttagtagagatggggtttcaccatgttagccaggatgatctggatctcctgacctcgtgatccgcccacctcggcctgccaaagtgctgggattacaggcatgagccaccgtgcccggtcaacagtgtactattctagcatattgtttactgattggggagtcagttatagccctggtttttactctgtctagttaatatctcagaaccttcaaattttttttttttttttttatacatgtctcactgtgtcacccaggctggagtgcagtggcctgatcttggctcactgcaacctccacttccagggttcaagcgattctcctgcttcagcctctcaagtaactgggattacaggcacgcgccaccacacccagctattttttgtattttattagagatgaggtttcaccatgttggccaggctggtctcgaactcctgacctcaaatgatcgacctaccttggcctcccagagtgttgggattataggcatgagccacggtgcccagccacactttttgttgttgttgttgagatggagtttctctcttgttgcccaggctggagtgcaatgacgcgatctcagctcactgcaacctctgcctcccaggttcaagcgattctcctgcctcagcctcctgagtagctaggattacaggcgtatgccaccacgcctggctaattttgtatttttagtagagatgggggtttctccatgttggtcaggctggtctcaaactcccgacctcaggtgatctgcccgcctcggcctcccaaagttctgggatcacagtgagccaccttgcccggccttgttttgtttttaatctgggactgaaaatgagggagttgaaatactaggttggtccttttttacattaagtgttttattcgtttaacatcattttaaaaacctcagttaattggagatgttcattttttccaagaaattgaattcaggtgtgcatattgtggttatgttcattaattgggagaggaggaagagggtgtacaagcctgtgcatgatgtgtgcaggcacatgtgttttgaagttattaaagtgtttgatatagtttagatttatttcttttggacttttatattttcccagctgatctccttgagctgtaagtttaaattacactgacttgttgaattgctatggcagtagtcctatgaatcaaactctggggatggggtctggctgtctgttttaacaagccttctaggtgatggtgatgcaagctaaagtttgagaactgctgatgtagttgaaatttaatagcagtgtttctctatgtgttacgtgtagtgatagattactacagaggtgggttaatgagggaagataaattgtttaagaaactaataataggggaccagtcacggtggctcacacctgtaatcccagcactttggggactgtgccaggcagatcacttgaggtcaggagtttgagaccagcctggccaatatggtgaaacactagctgggcgtggtggcctgtgcctgtaatcccagctacttgggagacttgaggcaggagaattgcttgaacctgggaattggaggttgcagtgagctgagatagtgtcactgcactctagcctgggtgacagagggagactctacttcaaaaaaaaggtaataatgggaaaatttccagaacctaggcaacgtttactaggctaatcatagggttggaagatgtttgtcatcgtagatgctatccttcatgctatgctatccttcagctaaggtggtctttactcagtattttcttttcttttcttttcttttttggagacagagtcttttctctcttgcccaggctggggtgcagtggcgccatctcggctcactgcaaccttcgcctgctgggttcaagcgattctcctccttcagcctcccgagtagctgggattacaggcgcccaccactacgcccggctaattttgtatttttggtagagacggggtttcaccatgttggccaggctgatctcgaactcctgacctcaggtgatccacccgacttggcctcccaaagtgctgggattacaggcatgagccactgcacccggccagtattttcaaatagacaaactaaactagtgacatctgacattctagattggagttcttgatttcccttccagtcctagatttttttaatatagaatgttgagttttctaatttattagtatgctggaagagatataaagtcctggatagatataaagtcctgtttaaaggaatatgagaagacttattcttaaggagttgagaatctcttagagttaaagctgttaggttagtgagtaatttaaataagtggatagtaatagatactcatggaagagacctctgtaggtgttgtcaaagatggctaggatttgggtggataaaaaagaggaagtcattctaaggaactgaatgaggtgagaatgaggagagtttttgggtaatggtgaaatcagctaaagtagaatggagcttataaatgctggataataatgtagaacctgggagattaaatactgtgatgaaaggtaagcagaagtcatcacattagattcttttggggttgacctgtggtaactatgtagattggttatcttttgccttatgttaccccaaaacttagtggcttaaaaaaacaaggatctgttatatcatagtttctgtgagtcacaattctggatgcagcttacctgggggcctctggcttatggtctcttacaaggctgcaaccaaggtgacggcttggtagcagttctctctctctcttttttttttttttttttaaagacagaggcttgctgtggtgcccaggctggagtgcaatggcataatctcggctcattgcaaccctcacctcttgagtccaagtgatcctcttacctcagcctcctgagtagttgggactatagatgtgcaccaccacaccccagcttatttttttgtttttgtgggttttttggtagagaccagtatttttttgttttgccatgttgcctaggctgctcttgaacaccttaattcaagggatctgcccgccttagcctcctaaagtgctgggattacaggcatgagccaccgtgtctggcctgggtagcagtcctcaaggcttgactggggaagcttccccttccgagctcactcatttggctgtgaccaggccagattttcactggctggttgttgcccagagatatcagttccttgccatgtgggcctctccataaagtggctgacaacacagtagcttgtttcctccagagtgagggatcttagagaaaaggcccatacgatggaagccacaaagtttttataacttaatttcagaagtaacgtcgcatcactttgcaatattctatttgttgtaagtgaataaccaaatccagcccatactcaatcggaggggattatacaaagatgtgaagaccaggaggcaggggtctttgggggctatcttagaggccggctgtttgtctctgtctctctctgttaagaggtaaattacagctattgtataatgcctttctatccaatctttttgtatgctattgggagaacatagtgttttggattttttattttggattaaccgtaaattaattacttttggctttgcaaaacattatacctgtaaatgataaacattcctaataacctttcagtggcttaagtttaaaatagcttgtagtctcagaattggtaggaatttgagattctccagtttactgattttttttttttttaactctagctacgtaatggaatcacctggggatttttttcattactgtttttaaaatagaaaattgtagattcacagccgggcatggtggctcacgcctgtaatcccagcactttgggaggccgaggcaggcggatcacctgaagtcaggagttcgagaccagcctggccaaatggcgaaaccccgtctctactaaaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattcccaccagcagcgtagaagtgttcccttctcaccacatccatgacaacatctattattttttaattttttgattatagccattcttggcgtgactgaagttgtatagcattgaatcccacgtactctaccgattttttctacagtggtaacatcttataaaaacagtatcttgcaaaacatcttgcacagtatcaccatgagggtaatgacattgatgtgatcttactcagattttcttacctggggattttaaaaaatacaggcaggcaggccctaccccataccaagtaagtgggtctctggggggtttggaccaggcattgccgttaaacaagaatctttcctggattattttaatgcacatccaggatcgagagctcctgcttttgtaagaaatctttctaaaacactgccgtctctgcttaactacaaataaataacagtgagctatttttgtgatgcatctcaatacagtgtttgcctattgatttttttttttaatggaaagaaaatctacttccgtattagctttcactcattgttcttagtacctgtagcaccctgaatggttttgttttttatataactatcattttggaatcctgaaggaaaaatttttcttcctgaggttaatcaacccccctttcctcagtcattcctgccttctaggtaattgctgtctttcttataataggcatagtatcataggccataactttgctaaattattgactgtatatacacaactcatcgtttgatcttgacactatattactatgtaactttgtataaatagcttaattattttcattaaatgatgggataaatagaagaatgagaatttatttaggttgacattattggatgagatagtaatcaggctgtttctaacctggagtgactggatcctttggggcccatggagatagtagtggtggtccttgcattattttcagtgttttaaaaagcctcatgtatatttttttaaaaagctgtcaagccacttttataaagtcagtagatttctataatcacttatgatttaagtttctttctaaatttttaatttttttttccctaaattgtcattcacctagtgataggaggtcatctggcttgaccatacaatggtttccccttatctacagtttcagtttccaaggtttcagttacctgaggtgtgcagcagtctgaaaatattaaatagaaaatttcagaaaaaaacaatttgtaagttttaaattgtacaccattctgagtagtgtgatgaaatctctcaccatcccacccaggacgtgaatcatccctttatccagtatatagcagtatatagactacctacctgctactggcctcggctggtcacttcactgttaccagattgaaaaaacatagcatgtataagttcggtattacctacactttcaagcttccactgagggtcttgggacatgttccctgaggatgaaggggactgctgtaatgtctcatttgatacagcttggggtatagttgatgcccagttagtgtttaagtgatggatagtatgctatctcagaaggtggcttaaaaaattcttaatgctctctaacatctgctctggcaaatcagctttccagagccctactttttttttttttcatttttaaaaatgactttttttttttttttttttttgagacagagtctctgtggcccaggctggagtgcagtggcatgatcttggctcactgcaacctctacctcctgggttcaagtgattatcgtgcctcagcctcccaattagctgagattacaggcatgcatcaccacacctggctaatttttgtattttttggtagagacagggtttcaccatgttggccaggctggtctcgaactcctgtcttcaggtgatccgccctcctcagcctcccaaagtgctgagatacaggcatgaaccactgtgcccagcctgacaattttggttttaaggccaaaagtttgaagatttaaatgaaaaatgccaaatattcaggaattttctcctattattattattatttttttttgtatgtaaatattgttgtgtagtattgttctttccttttttgctctgttccatttaaaagtgtcagaagtgccctgacaatacattttggcaaaaaacagagcaggtaatgaagtattaggtaacattttcttgttactgagacatttgcttagacaatgctaagaatagctatcatcctagacacttctccccaggcttgctttgccattgcctttgaaactgtcatacttataactcagatattaactggctctaattacctggtaatatgtcctctctcctaatcacaattgtacagtgtttttagggataaagtgtaaactagaaaccgagaagtattacctgattcttagcaagtatttataagtgaaagcctctaatgtggacatttatcttggaatttgtgacatttggacagatatttatctgaaacttacttgaaactcaaatttaataccttctctctttgaggcttttcccccttttattggcttatctgagaaccattcttgggatttgagtcatccttttttttttccttcattttccacatccagttatccctgatcaagttacctctgaaatttgtttcatgttgttgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattagctgggcttggtggcatgtgcctgtagtcagttacttgggaggctgaagtgggagaagaggattgctgagctcaggaggtcaatcaaggctgtagtaagccgagattgtgctactgcactccagcctaggcaacagggtgagaccatgtctcaaaaaaaaaaaaaaaaaaaaaagacagttgaatcagtttaatacagtacttctcaaagtatggtccataagaacaaaactatttaataataacagaaagacactatttgcctcttaaaatgttctggcatttgtgctgatgttgcagggcaatgaggaggtaaaaccactggcaccttagtacagaaggtatcagtggcaccaaagtatgctagtagtcattgtgttcttcactatcacacactcagagtaaaaaaatacgtttcacttaatcctaaatgaataagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattagattctcataggagtgcaaaccctattgtaaattgtgcattcaagggatctaggttggcactccttatgagaatctaatgcctgataatctgaggtggaatattcattgttattgtctgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatcattcatgacaagcagggatgggagaggaagcagggataggagtggttatgtgggcagccaatagcataggaaacttaaaaggaacctacttagccaaacatgttttgagcctttgagtcccagtgactaaacaatgcagattaggataaaagatttgctcacacctgtaatccctgcactttgggaggccgaggtgggcagatcatgaggtcaggagttcgagaccagcctggccaacatggtgaaaccccgtgtctactaaaaatataaaaattagcccggtgtggtggtgtgctcctgtaatcccagctactcgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaataattctcgaccaaagtaatagaatacatatatattatataaaatttgttcgttatttatgtatgaagttacaaacttagactagtggtccaaaaagcccagcattcttctgaaagaagcaccaagagattctggaagaatagcaccgtgaaactgttatggaggcactagataacaaatgcttgctttaaagggagaagagccagtttattttgctcggtaatgagaaaatagttctttagtaaagttctcaggtgagcttattactaatgccgtttaacttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattctatgtacaaaacaaaatatagaaataagatgtatactgagcttttctccataacctcagattttttttaaaaagttaaaacagtcttagtatgctaagagtgactgtttataaacttttttaaaggattttaaattttttattgtttgtgcatacatatattttcttggttcaaattcaaaaagcacaaaagatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaacttggtgaatagttaatagttgctctccattccctcagtaaaagagacctagggcagtgttcatgacaggctctcagcttgtcggcctaagtggcaaaattaaccagtcacgatagcccttatactgtgtggtatcatttatacaaaatgtcctgaattggcaaatctatagagatagaaagtagatcagtggttgtcagaggctgagtgggggaaatggggcgtgactgctaatgagtatagggtttctttttagggtgatgaaatgttctaaaattaatggttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcgtggtggctcacgcctgtgatcccagcacttagggaggctgaggcggtggatcacccgaggtcaggaattggagaccagcctgaccaacatggcgaaaccccgtctctactaaaaatacattagctgggtgtggtggtgcatgcctgtaatcccagctacctgggaggctgaggcaggagaatggcttgaacccaggaggcggaggttgcagggagccaagatcgtgccactgcattccagcctgggcaacaagagtgaaacactccatctcaaaaataaaaaaaaaaaagaactcttcaaatttttattaatctggtaaagaaaatactagttgttttaatttacatttttctgaattgcctttttatgtcgtttgcaccttttcataaatttttttttttttttttttttttttttttttttttttgagacaaagtcttgctctgtcacccaggctggagtgcagtagtgtgatctcggctcactgcgacctctgcctcccgggttcaagccattctcccgcctcatcctcctgagtagctgggaggcgcacgccaccacacttggctaatttttgtatttttagtagagacggggtttcaccatgttggtcaggctggcctcgaacttctgatctcaaatgatccacctgccttggcctcccaaagtgttggcgtgagccactgagcccagccagtaatggtatttaatgtataattattgtagctctttctccagtttgttatttgtaagaaaaaaaaaaagcaatacatgcatgtggtaacaaatgtaaatgttatatcttacaatgattacatttatagctttaatatgtctcttccttttgacattatctctttcctttttcttcctccatccttgagaaccccactttatgccagctatagttatatgttatcaaaatatttttgtcttgtgattataaccaaatgttattagttcgcttatagcttgatttttgaagtgacatcattgaatgtttgtttttatggtttataaatatcaatgacattctaagtagtgtattatgattactgttgctttttgtttttaacaggtctaatttcaaatgctgtgaaccttcctaagaacagtactctggtagcaagatggtttgggtttatttatactccttggagcccttcattctgctcttgtaatcaggatggctttccctgtaagcctcttacatatagctctcaaccatggactttgcatcattctcctgtgttggagcctctgattcttagatacatgtctttttcttgactgaatctcattgtgctggactgcatccttaatttaactctcacaacacttttttcccccctgcaacactcttaggctgttacttattgtggctctgataatgtgcttaattttccttcaaacttgattgctagattggctaggttggaaactctagattagaatatttgtgcaagacattgccttctgcattcactgttggtgataagactgatagtagtctggttgtcatttctctcttttttttttttgagttggagtcttgctctgttgccaggctggagtgtagtggcacaatctcgtctcactgcaacctccacctcctgtgttcaagcgatttctcctgcctcagcctcccgagtagctgggactacaggcgcacaccaccacgcccagctaatttttgtatttttaatagagacggggtttcactgtgttggccaggatgatgtcgatctcttgacctcgtgatctgcccgcctcggcctcccaaagtgctgggattacaggtgtgagccactttatgactttatttatttatttattttttaagtttcagccttttctctgaagagatatgtaagtgtgaatcttctaatccattgtgctggatcttcagtggaccctttcaactggaagacttgtgtccttataaagctttggggaattaacttctgttactgctttgctaatttcattccctctcttcttcttttggaattcctatcagttgaatgtgaaaaacaatggatataacttaaaataatgataagttatggaagaaagattgagaggtgcatgtagcgtgccagatcctcatctttcacattaggaaggtgacagataatatctaaaatagaaaaataataactccttgagcataagcatattatttagcataaaagtaaatactagaagacacagaagagtttaaaatggttacctcagaggattagaaatcagtagtgactgaagtatggcaaagaacactgttaaatcttgcagtaccattaacttctaaaactatgtatgtatattaaataaaataacttaaaagtgatttaatgtaatccttaaggtctacatttaatgataccttcattctttaaaatatcgtcaggaagtttatgtagacgtgttcttagaccaaatatacactatcagccttcatgggaggaggtacacactatgtattcctttgtcatgattcgtaattattgagctgtgtattttgagaataattgatagagaatgtactggagatttacatggcctgttattgcttggttttaaaacttaaaggatacaggggtatatttttgtctaattcaagatcatttggatttatgacttttattagctttaaagaagcctacaatggcttttttcaaaaatagaatttttcttagaaaacagtttttaagagacaaatttatttaaatgcccactcttttaaaataaagttagatgtatggttttcaaataatcttatgtttgttattgaacaaaatcttatttactgtatatacaaatatatagtatggatgagtaagaagcagtgaattgctaatcagaatcccaccacttatcagtaagtgttttgagttgcacggtttgagaaagtactggttcaaatgctgttaaaaatcaaatttttgtatgctgtctctagatggtttgttgatgacctagtggttgtgttaaagaagtggagttacattgaagtcacgcgaatgttttgcttgtgtgtttggtggaacatttttagtatatgccacagcagatacgtggaatgctgatacttagggcttaacagttggaacccagaagtgagtatgtgaacaaataactgaaaggttacaaaataactttaatcatctcacaattctaatcaccacaaaaataataaagtagcatgaggtggtctatatttatggtttacattagccccactgtgccagggcagtttggaatttaagttacctggttcttggctctacctttagtttgtaccctttttatcaatagggcttttttgcccctataaggaatagccagttaagagactgcaacccaagaaaatcttgcctgaatggagtttcaggtaacgataaaagtttaaaaactagggtgttatatatattagaagtgacttgtctcttgatgcaaagtcatagactgctattttaagtcttgagtatttttttttgatataacattgaaggataccttacctattgtttctattgttcatgtaaatatacccttccattatctctccccactttggtttgccgctgaatttttatggaagaaatcaaatgattatacatagtgataacatccttctacttacagaaacattgtattaaaacactgattaaactcttgatgttttctagaggtgaaatctttatatttgggatgacatagaaggaagtaatttccctcataaaataaatgtgcaaagaacagcaaagcccagatgtgtcattggctaggcacatttattaacaagtttggatgcatcaggattacatatttaaatcaaatgcatatctcagcaaaatttcaaattgttatgtatttataggattgccaacagttaattgaaacttgtcattgttaaattttgctttaaataatctccaagagtaatgagtggctgggcactcactcatggctgtaatcccagcactttgggaggctaagacaggctgattgcttcagcccaagagtttcagaccagccagggcaacatggcgaaaccctgtctctacaaaaaaataaaaaaattagcctggcatcgtggcacgtgcctgtagtcccagttacttgggaagctgaggtgagaggattgcctgagcctgggaggcagaagttgcagtgagccaagatctcgccactgtactccagcctgagcgacagagccagaccctgtcttaaataaaataaaattaaaaaaaagagtgatgaaggtatgacattcctgcctgctgaagtaatctgagaagcctctttaagggggagttctctcaagaatattatcctcaacatttttaccttttaccttccttctcctgtggtagcttagaagtaaatattcataactgggaagtttgatgatcagtgtttagttgtaaattcttttaaaatgcacatacttttaagccatctagagattgtgtggattgtctcccttagccccactaggtgcttctctgtcctaagtagtctagaaggccaaaaactatttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtagtcactcctggagacatattcctatagccccattcctccattctttcccgtaactaagcatctaattcctttttaactcccctttgctcagaatatctagtggtttctattccctccaccaaatactgattgatcaaagtcaagagcatcctttggtgacaaaatgctactcttacatttagtagatggtactgtatgtgatgcaggatttttcttgaccccttctttggacttgtgatggaggtgccccatttactctgcttgcagccctcaaccccttgcaggagggagcacgtgagcaagtgaatgcgggatctggctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctatttatttgaaatttctttttgaatattaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttgcccagaggtggagtgcagtggtgcgatcttggttcactgcaccctctgcctcccgagttcaagcagttctccttcttcagcctcccgaggagctgggattacaggctcgtgccaccatagcgggtaattttttgtgtttttagtagagatggggtttcaccatgttggccaggctggtcttgaactcctgacctcatgatccaccctccttggccttccaaagtactgggattacaggtgtgagccactgtgcccagccaatagtatcagcttttaaaaacttagtcattgtgggccaggcgcgtggctcacgcctataataccagcacttggggaggccgaggcgggcggatcatgaggtcaggagatcgagaccatcctggctaacacggtgaaactctttctctactaaaaaatacaaaaatattagccaggcgtggtggtgggcacctgtaatcccagctactcaggaggctgaggcaggggaatggcgtgcacccgggaggtggagcttgcaatgaggcgagattgcgccactgcactccagcctgggcgacagagcaagactccgtctcacaaaaaaaaaaaaaagaaaaaaaaaaagaacttagtcattgtggaagatttaaagcattcattgtattaaggagattggatattttcgtgtgtttttcagccaattgtaatatgggaattgatgaactgtccatttttgttggattattttcttttttgagtgggtatgcttgctcatttttgttgtagcatttataaatattccttagaatacagatgtttttatactttgtgacttttgagtttctaatattgtttaaaaagtattaaaaaattctctttaaattttggacccataagcagctcatttgaggagcttgtagattttatgcaaacatgagcccatgcttctgtaggaaaatcttaaaactgaggtttaaggtggtgcctctaacctgtttaattctcgttcagatcaaattctgaaataataaaaaggtgggttttggaggttttctgtgtatgtaaactggaataaaaaagtggtttttttttgttttttttgtttgtttttttacttagctttatcctaaaataagaaagttgtctcttgagatttttgaaaaagtagttgcctcccactctgctaaatataggaatgtcattcagcaatttggttgtgattatttttatgtatgtatgtatgtatgtatgtatgtatgtatgtatgtatttatttatttattttttgaaacgcagtcgtgccctgtcgcccaggctggagtgcagtggcatgatctcagctcaccgcaacctctgcctcctgggttcaagtgtttctcttgcctcagcctcccaagtagctaggactataggcgcacaccaccgtgcccggctaatatttgtatatttttggtagagacggggtttcaccatgttggccaggctggtctcgaactctgacctcaagtgatccgcctgccttggcctcccaaagtgctgggattacaggcgtgagccaccatgcctggctttggttgtgattctacctggagagtttgtcatactcttgaatatgggcctgtctgcacacatgtgtgcatccagattatgattctccactgtgactgcttattggaatctcttgggagtttttgaaaatggtaatgcccaggtgtccccctcagtcctcttcctcactccccccatattctgatatatttggcctggggtttgtggcttgtttaaaagcttcctagatggctgtgcacagtggctcattcctataatccctgtgttttgggaggctgaagctggaggattgcatgagcccaggaatttgagaccagcctgggcaacatagcaagatcctgtctttaaataaaaataaataaataaataacagtcaattaagagcttatgtgctactaaaattgagaactacttgatcaaaggataggggatgatggtgcaattgatgttaaagcttcagctaggacagttgacataatcagacttactaatcaactttttcaaaatgcaaaactttaaagtaaatacagctgctctgagcctggaatgttattttctttagattactaaaatactatactgccacattcatgggagttctacagatgtactttttcggagcctgtgtagtgggaaattgtttagagcagtagttcccagttctgtctgcatgttaggatcatctggggaccttcagataaaaatgttggatgaaaatatatatattcatattctacccttgacagttgaatcagaattgctgggggcaaagcccaattaatggtattttttaagttcctcaggagattcttatatgtagccagaatggacaggggtgggtggtactgatttagagttataactagacaagatgtaaggttttaggttgttctattgtcctaaaagttaaatgtactgctgctagtattagtactagttttctgattatagtgattttactcaaactgtttttgtttggtttgtttatatcctttaaaaaggatgaagagctctttatttcagccaagagcttgaattggcttttcactgaactatcagttttggtggcacaccgaagtgaatttctctcctttgacaagtccttgtagggagtggtgctataatcataaattaaaaaataatttctccatgtattcaaatcctactagcctattttatcctggaccaagacacttaacctctgtaacctcatctgtaaaatgtaaatcatatctaacttgcataaaatattgatgtgagtattaaatgaaataatgtatataaagtatctagcattgtgcccggcactaaataatttcaaatctatgttctccttttcagcattcccttttactctcattgttctttctttcttttttttttttttttgagacggagtctctctctatcacccaggctggagtgtagtggtgcagtctcggctcactgcaacctccacgtcccgggttcaagcaattctcctgtctcagactcccgagtagctgggactacaggcatacgccaccatgcccggctaatttttgtatttttagtagagatgaggtttcaccatattggtcaggctggtctcaaactcctgactttaggtgatctacccgccttagcttcccaaagtgctgggattacaggtgtgagccactgtgcctggccctttttttttttttttgagactgagtcttgctctgttgcccaggctgggtgcagtggcctgatctcagctcactgcaacctccgcttcctgggttcaggtgattctcatgcctcagccacccaagtagctgggactacaggcgtgcatcaccactcccagctaatgtttatatttttagtagagacaaggtttcatcatgttggtcagcctggccttgaagtcctgaccttaagtgatcacctgcctcggtctcccaaagtggtgggattacaggtgtgagccaccacacctggcccacattgttctttttaaaagaacttcactacaggtgctccagtgcaggctagattacgtttatagttgaatactttaagtttcatacaataaaatttacactggagcatacagttctctgagttttgataaatgcctagagttgtgtaaaccaccaccatagttaatttacagaacagtttcccctcaccatcacccctcaaatttctttctaccccattgtttagtcaaaccctcccccacctttaatatttggcagctctggatttgtaccctatccttacttatttatttctatttattttcactcattcatttaagacagggtcttactctttcgcccaggctggaatgcagtgatgcgatcataggtcactacagccttgtgctactggactcaagggatcctactcacctcagtctctagagtagctgggactacaggcatgtgtgtcatcatgcctggctaattttttaaaaatttttagtagaggtcttgctttgttgcccaggctagtctgaaactcttgggctcaagcagtcctcccgccttggcccctcaaagtgttgggattacaggtgtgacaccaatcgcccactccagccccacctttttttttttttttccccaaagagagatggggcctcactgtgttgtccaggctagagtgcagtgactgttcacagatgggatcctagcacactacatctttgaactccttagctcaagtgatcctcctgcctcagcctcctgagtacctgggactacagggatctcccacctcttctggcctgagccctgtaattttgccttttccactgtgtcatttaaatagaattgtaaatcaatttttaaaatgggcttttattttcttgttaggtttttagatttttaaaaaattattctaggtacaaattcttcatcagaaatgtaatttgcaggtatcttctcctagtctgtggtatatcttgtattttcttaacagtatcttttactttcgatggatttcagtgtatccgttttctctaatggattgtgcttttgatgtatgtacgaactatttgtgtaactcaaggtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactcaaaaaaaaaaaaaaaaaaaaaaaaaaaaaaaaaagactttttccccgttgaattgttttatcacttttgtaaaagatcacttttgctgtatttatgtgggtctatttctggtctccattccattcttttgatctgtatatctttttgccagtactgtaacttcatagttatgttttgaaatcaggtgttctgttttaaaatttttcaaaatttggccactctagtttccttggtattccatataaaatttagaatcactttgatgtttatccaaaaaatatttggagtttgattggcattgagtggaatctataggtcagtttgggaagaattaacattttaattatgttgttttccaatccatgaagatggcatctctctccattatttaggtcttattaaaatttctttcatcaatattttgcagttttccgtgtacacgttcttcacatattaaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatcatttcccttccacccaaagaatttcttatagcttttcttttagagcaggtttcaatctctctctctccctctccctccctccccctctccctccctccctccccctgtccctccttccctccctccccctccctccctccccctctccctccctccctccccctctccctccctccccctctccctccttccctccctccccctctccctccccctctccctccctccctctctgtctctctccctccttccctctaccccccgccccgcctccgccaaagacagagtcttgtctgaggctggaaggctggagtgcagtggtgtgatcacagctcattgcaacctcagcctcctcagctactgggactaatacgccaccacgcccagctaattttttgtagtttttgtagagatggggtctcaccatgttgctcagactggtctcgaactcctgggctcaagtgatcctcctgccttagcctcccaaagcactgaaattagaggcatgagccactgcacctagcctgttttttgcttttttgtctgataatgtgtttgtcttcatttctgaactatacttttagtgaatacagaattctagcttgataccttttgatatcctataggggcctgagagattgtttgtttttaaaaaatatttcttctctcttttgttaagattggataatttgtgttgccatatcttcaagttcactgactcttctgtcatcttctttctgatagtgagccggtccagtgagtgagttctaaaattttcatttttttaaaaaatagtaaactctttcttttttgagaatttcagaccgggctctgtaatcccagcactttgggaggtcaaggtgggaggatcatttgagtctgggagttcgagaccagcttgggcggtatacaaaaccctgtcgctactgaaaatacaaaatattagctgggcacggtggtgcatgcctgtagttcagctgctcaggaggctgaggtgggagaatcacctgaaccaagaggttgaggctgcagcaagctgagattgcaccactgcactccatcctggacgacaaagcaagaccttgtcttaaaaaaaaaaagaggattttggccaggcgcagtggctcatgcctgtaatcccagcactttgggaggccaaggtgggtggatcatttgaggtcaggagtttgagaccagtagagggggtttcaccctctctactaaaaataaagaaaattagctgagtgtggtggcatgcccctgtaatcccagccactcaggagaattgcttgaatccaggaggcagagggtgcagtgagcctagatcacgccactgcactccagcctgaatgacagaacaagactccatcaaaaaaacaacaaaaaagataatttcacatttcatttgttttaaggtgttctttttttacctaatggatcatggttgtaataactgctggcctgtaatccgagcactttgggaggccgaggtgggcagatcacctgaggtcgggagttcgagacctgcctgaccaacatggagaaaccctgtctctactaaaaatacaaaaaattagacgggcatggtggcgcatgcctgtaatcccagctacttgggaggctgaggcaggagaattgcttgaacccgggaggtggaggttgtgggagccgagatcgtgccattgcactccagcctggtcagcaagagtggaactacgtctcgaaaaataaaaaataaaaataaaaaaatataaaataactgctttaaaagtctttgataattgtaatatctgggtcatctaggagtcagcatctgttgattatcttctgctttaagaattggtcagttttttgttttttgtatttgctgtgtttggtagtttagattctatcgcggacattttgaatattgtattgtgagattctgagtcctgttgaagtgctgtagagaaagtttaagatttgttttagtagacaaattgacctatttagtttatacctgcaaattctttctcatcttacataggcagtggttccattatctcttcagttttcaaagtctttgccatgttgtttgcatttgcccctcccattcccactttggttgatctagcacttgagcagtgatttatatcctaattttattgtgaaagcctcccttacacttctttggatctgttccatatatatatagatagcttgcagctgggcccacagacttagggatctacttttctgtctcttaatcatcagtgatttcacctatattcttcagctcccaggggccttctttattcccctagccagaagcatggaattatagtttgagtctcctacctgtcatgcctcacatggcagtgagcacatttagggagcccttgccctaaccatattaaataaaaacatggtggtggaaactaggaatctgttttaacaaaacttaccatagttacttttgataaaccaataacagatttgggaacttgtggctagaaacaatatttggcactagcaacatcaagttatactccctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctattgaaccgaatttacaagaatcaagtaagggaattgatgaatataccagtatgtggacaacccagtgtgcaactagtgactgctttaatttcttgtattccccttttgtaaattttgcagtaaatttaatgttagggagttcagtcttagtgtttctttttatttgggagtatgtgtgtttgggggtgtgcttcagtatcttctacatatatcctcttgggtaccaagaactgaaagcaggtagagaaaaaaagcacctgataacattcttggagtacatgagtaagatcctcctttaattacttaaaaagatttcttgctcatccgggcatggtggctcacgcctgtgatcccagcactttgggaggctgaggcaggtggaacacgaggtcaggagattgagaccaccctggccaacatgctgaagccccgtctctactaaaaatacaaaaattagctgggtgtggtggcgtatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctctcatattaatgtatttctccaagacattctgaattttatcctataacactgctgaaaatatttttccattaaatattgtacttaatatttgtgtactattggatttaatgttgtactaaattttgtactttatatgggaactgtagcttctgctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaattacagacatgagccactgtgcccagtcgatatttgaattttttatttgattgtaagcatttttactatgtatgtatttaatgccccccccccccccttttctggctaattcgctttttgcataccactattttttttctaaatacactgtttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaagggatcctcctgccttagcctcctgagtagctggggttacaggcacccaccaccatgcctggctaatttttgtatttttagtagagagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtttttattagaaaaagaaaatgaggtaaaaaactgggctgcgcaccatggctcacacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagagacggggtttcaccatattagctaagatggtctcgatctcctgacctcgtgatccgcccacctcggcctcccaaagtgctgggattacaggtgtgagccactgtgcccggccttttttttttttttgagatggatggagtcttgctcggttgcccaggctggagtgcaatggtgcaatgtccactcattgcaacctctgcctcccggttcaagcgattacaggcgtgcgccaccatgcctagctaatgtttgtattttttggtagagatggggttttgccatgttggccaggctggtctggaactctgacctcaagtgatccgcccaccttggcctcccaaagtgctgtgtgagccactgcgccagcccaagctggtccacttttacatacatttgaaagcttagaaatggaaattacctaaattgtccctcaagaagaagtagaaaaatagagtaaacccataaccagaaaaatatggtgaatatagtaaaagattccactccttccccaaaaagtactggatgattttatgggtaagttctgtctcataaacgttcaaggaactgccagttcctgtagaaaattatctccaaacattgaaaatggtaggacatcattaattcatgttagccagatcagaataacccagttccaaaatttgacagacagtaggagaaaatgatacttataaatatagctgttgaatttataaataaaataatgattgaatcaacgactcttagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcatcatgttggccaggctggtctcgaactcctgaactcaagtgatctgcccgcctcagcctcccagagtgctgggattataggcatgagccactgtgcctggccaatttagtaggatttctcctaagaatgcaagaatagatcatcatcgggggaaaattttttcgtttataacatttacaacattaacagatttatgaagataaagaataatcataataaatgtcagttatgcattttaataaaattgtgtattaactcgtgatttagtgaaaactagattcttagcaaactgagaaagtgatttctcagattgattaaaggtatcaactaaaatctacaataaaattatagttaatgttgaagcatcagaaacatgcccattgtaatcaaacaaggattatggctgtcaccaccatttgaatgtattggaagttctgataaataacgtaatacatggaaaattaaataagtggcataaagactagaaaggaagataaattatatgtaaagtatataatctaggaaacccagaagaatcgactgattaactattaaagtgattgcccattaaaatcacctgagaagtgaaaaaaacccacagtgcccagtccctttccattacttcttccttcagttctcttggaaaatgaaaagaaacatggaatgtaagtagttgtagcttcggtgacccctgtgttcctccacattcttttttttttttctcaatttttttgtagaagcagggtcttgctatgttgtccaggctggtctcaaactcctagacacaagcgatcctctcacctcagccccacaaagtgctgggattgcaagcgtgagccaccacgttcaatctccacattttttgcatataaaaattgaggttacccatatggtaatcctgtaggtatttagtatcctaggaattgttaagaaaaggtaagcaatatacctacctttagtctacatatagcccataaggtttgtaacatcgtattttttaaaaatcgtgcttcctaatgggtaacactgaatgtattaaagtgtcatttctccttatttcgatatatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaaggttgtgcagtcaggaaaatgccaaaatcagaatgtcaaactattttagtggaggcactgttgctgctgccattgggcacaggtatcactgctgataacatcaatattgggcatatgacaccacaactaatacctctgcaacgtctgaaagctggatatctccttactcctttgatagattacctcattgaaccttctttgagtagtgagtttttgataaactgtctccctgctcctgcctgggaggaattctctcacctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggggaaatggttggaaatgtttaatgcacgttataagggccttgaattttaagtaagtgaatttggaatttttctgtctttattgggaagcccttgaacgttgttttatggagaaatagtgatggaaaagcattatttcagaaaaaaatctagtaataaatgagctgttttaactatccaggtaaaaggaaaatattgtcctgacttacaatagtgacagctaaattgatagcagagggtagatggaaagagaagtaaaattagttttaactgagacaaaatataggagactctgggaaacttctggtaattttgaccgttcctttcactaaatacactagaagaggctaggtgaaatactgaaacatgtttgaaaagtaagattatcaaataattagtaagataggaaatagaggttcaaggttgagagtttgggaatcaagggaaatttagagaaacaagcttccagtccttgttgctctagcagtgtatgttgatccagaagaggtagctaagagacttagctgtgagttttgtttgccctttgttagtagagggggaagttggaatattaggtctactaagagcgaaaattgaatacactagctccttaaagactgaagatgatcttcatgtcttttgggtagtccagaaaaccttaaaccttgaacttgggttaagatagcccccgtatataacagaaacaaacgtaaatcttctctagggaaataacattatttaagaccttaaactattttctcaaattatttttctaattaaaacataacaacctggaacttaagatactggaattgtcagacctagaccaaaatgagtatgctatcaccagggagctgtcattcagatttggaaaaaaatcagaatttttataactaaacaaaataagcaaaattaactttgtgacatagtttaacagcagactggacaaagctgaagagagtttagtgtatttgaaaatcaaacaatgatccagaattaagtatatccattaaaagatggaaaatacagaagagattaagaaatacagaggatataatgagaaggtctcattgagttttagaaagagaggagagaatgtggcagaggcagtattttaagataaaaatgactgagaattttgcagattggtaaaagacccaaatgtcatagattgaagaaacataacagttcccatgtgtgatagctacttgtttcactgatcctaagatacacagtttttcacattttaacatctgaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatggaaaatatattcataaacagtatgttttaattaatataaatggttttatgttgtacctagcttttgtatctttttaaagccaaccaacattttgttctgccagtgttgattgaagtttcaaatactcataattgttatttaagcaactatttgtctgttaaagggaaaaatcttgcagaatgttgtactttggaatttataaccttaaatgcataatgagctaagcattcatcttaaaagtctcaagtaataagcttagaggtctcaagttaggaaaagaacaacaaaataaatatagggaaaatacaaggaaagaaataaagaacagaatataataaaatagaaaacatgcagtagaagggatcaagaagccgtaagatttttttttttttttaagactgataacgttgacactttgatgaggttaggaaaaagagagatcctaaataaccagtattaggaatgaaaacagagtatcactaggatcttgtggatggtttaaaaaaaaactcttaaaattatggacaactattcaaacttgatagacgaaatgggtagattcctagaaataggcaatttcccaaaactgacataagaaatagtaaacctgtatccttattaagtataaagaaatgaaatccataatttaaaatgttcttataaagaaaagttgaaattcaaatggttatactggaaagttctaccataacatttaatatgacagtaacttcaaccttattctaaagaacagaaaaataggatcttctgccttcataaagatatcataacctttataccaaaacccaaggaaagatgatacaccagtttgtcttatgtacatagatacaaaaaaaccatacatacacacacgcacgcacacaaaacaaaaactggaacaacagaaacacctcagaatattagcaaattgaattcagcaatacatatataaaaaggagggtaacccagcatggccacctgaggtgaatcctgggaatgctaggttggtttaacctgaaacaattcagcatgattggtcacttgaacaaattgatgagaaaaacatttcagagatgccaaggagcctttgcttcatgattttaaaaagaagctattagcaatctagaactttgttaaccttataaatcttacagaaacatttgtaggagatatcatagtttatccactgaaatgttaaaaaagatttcccttttagatgggagttcaagatgtggatatcgtatctccagttcaattcagcattatactagaaatgattctagccagtagaacatcaaaaaatgaaaacaaaatacagtgttgtaagagaaatgcctgtgtttttgggggttttcttttttttgagatggggtcttgctctgtctcccaggctggggtgcagtggtgagatcatggctcactgcagccccctacctgccaggttcaagcaattctcctgtctcagcctcccaagtagctgggactacaggaccatgcccccaagcacagctgatttttgtatttttagtagagatggggtttcaccatgttggccaggctggtcttgaactcctgagctcaaggaatccacctgtcttcagaagtgctgggattataggcgtgagcccgtgggcccggcccctggctgttaatattcactgacaatgtgattgtgtattcacaaacaatgtgattgtacatgtggaaaaatcagaatctggaggtaaattgttagaataaatgtctttagaaagaaatatgaaaaatttcttttttctttgacccaataattccgctctcaggtatatatccaatagaaagaaatacgtgcacatctacattgaaagtcatatataaaactggtggtggctcatgcctgtggactcagcaacatgggagaatcgcttgaggccaggagttacagatcagcttgggcaacatagtgagaccccgtatttacagaaaattaaacaattagctatgcatggtggcatctgcttgtagtcccagctactcaggaggctgaggtgggaggattgctggagcctaggaggtcaaggctgctgtgagccatttttatgccactgcactacaacctgggcgacagagtgagaccctgtctcaaaaaaagaaaaagtcatatataagcatgttcctagcagtatttattcatacttcaacctataaacaacccagatgtttatcactattacactagatagataattatggtatattgacatagtaactattcagcagtgcaaaataaatgagcaaaagctacaagccacagcatagataaatcttaaaaacatagtgaaaagaaaaggaccccaagtaatacctatctactatatggttctacttacataaaatataaaaacagttgaaactaagtttatattgtttaaggatgtgtgtttaggtggtgtagctatttaaaaagggcagtgattaaaacagttgaaactaagtttacattgtttaaggatgcatatttaggtgtaattattaaaaaaaaaaacagggtagtgatcatacgtttaggggggcttgtagagtactagcagtcttctgtttcttgtcctgggtggtatttatatactggtgtttgttttataacagtttgtaagctgcatgtttatgtacttctctaggattgtgttattgcaaaataaaaatcattttaaaacacatatacacagacataggaaaaggatcagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagagctgtagctttgtacagaatcagagcgtatcaagaatacttcattctggggttgtgctcatagccatcacgtacaattctgtgcatcacaaatcgatgcctcctatgtcttcttattgtctgtattctttttttttttgagacggagtctcgctgtcgcccaggctggagtgcagtggcgcaatctcggctcactgcaggctccgccccctggggttcatgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggccttattgtctgtattcttaccacatttaccaacttgtttcaacatcttgaagttagttttctgtacttctctaggattcttctcccattcttgcatgctaagtagcatgtcatactacaaacaggtattcatctctttccttccaaacaattgacattacaactaactagcataattcctacatatagttgctgaataggtgagggaactgtgttaaatggaacttaattatattactaccttgtgttttgatggataatttgttttaacatagctgaattttaaacatacttgtttgattcataggctttcaacttttacagcctgaggacttgcattagatatattgaaaaatcgttatcaaaacaataaaaagacaatttctttttatatacttgaagaaacgatatttctcttcagttggaatgagatccactgttgcatgaatcacaagtagtagtgtgttttattttctagataaaaatgtatagcaggagcaaaagaccattaagcagagggtgtagatttcctttaatgcacgtatttggaaagaggtggacaaaaaaagccactgtcttggttttctttgaagtaaaaatagttttttaaaaataatggttcttgtcgttttggggactgtagtctcttttgaaaaagtaatacaatcttgaaccttctcctgggagtgcgggggtggggcgggggcagagaacatttgtaaataagttataacatttggattctgcccaattgttgaaatgccagggacctccaattacaaatttatgtgtttgatgatcttggtaaaactgaaatagtcataagccagaagtcgtagacaaccaccagtaaagatgacacatgtgtttgtagtgtggctggaacaccctgtgaaaaccagcatctgtgtcttctaaagcctgtattgtacagatgttctccattctgtgttagaaaaagaatagtcattaacttcttttgtaaatgtcctccatacttttatttttatcttttaaattttatttctaatagagatagggtcttgctatattgttcaggctggttccgaactctgggcttgagcgatcctcccagcttgtcctcccacagtgctgggatacaggctcactagctactgcacatagccttttttttcttttgaaattttatttacctgcatagttttacatctacctttaaaactcatgagaaacaataaaattttattatgtaaaaaagctttttgattagcaaaattttttatcgtaaaagctgaatgggggggatgtaagaggtcaatttactgttcacttggcttttgggtatttaggtttttctgtagtaaatgggtattggatccctttggaagatggcatagtttattgtaattctgttatggttttgcgaattcgagcctagaaagagttatcttaacatctgtttcactgtggttagttccttaatccacctgccttcatcctggctcagaactaaaaaggttaaagtatgcagtaagatttttgtgctgccacttggaagtagtattaattagtagctgctctatcaagcattcttttgcttagcagtaagcaaacttaggagattttattacaatgctgtttttttaggttttattttattataatgcctttttaaaaaaaattaggctaataagaaaaatcttatggcctcaaaaagtattctactttttctgaaaaatatatgagcagtatgtatatttagctataaaaactacatagaatacccatttttttttagagattagcttaagaaacctaagtcttttatagcaagctgttacagatttgtgtgagttctcatttttgttgttgttgttgttgttgttgttgtttgtaacatgagggctaaaagctttccttaggataaaaaggttttctatccttaactcctttagatggtttttgttctttggaattctgaacttacctagtagaggtatgtagttatgccagtcatcttacattcttttgaaagaataactttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctctctcctcaaccagacataagagctcttaggctgtaactttcctgccttgaaatttaattcatattatttggtatgtttctctatagcaggcaagtaaaatgaaaaattaagattcaaatattctggaaagttgtctgagtaccaggttgctcagctgtatttctgtaaatatactcaatgtgcagaaataatcctggagagaagagaatttacaatctactgagaaactgcttaaatccaatattttttaaattgacagattattgtctatatgaaaatcttaatgtagagaaatataggccataggaatgggtgttaacctgcttgtgccctttcttcactaaggaaaggctgaaggagaaaccatactgctgcttgtttttttactttgatcaatatgatttcctgaaaaggataggcagggttacagggaaggagagaagcacagtcctaggataagctttgcagctctttcaagtcaatgaagcagagagaagtatttggttaactcattaaagatgcctcaactacagtgctttacattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgagatgagggatcagaggtaaactgataaaacaacagaaggtgaaaagggaactgacagaacagaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaactgctaaagttcaagaataaagaaagaagaaaatgagaaaattattttggccagacttcctcagtaacaacaggtaacaagaaaatagaacactatctctatatgaatattgaggagggaagggattttggccaaagtgagcagttgaacacatttaaacattagaattatgtctaagtagttggaggtgatcaagtttatgagacaaaaaacagttatcattcttgaaagaaaggctacatgatataaaaacaatgggccgggcacggtggctcatgcctataatcccagcactttgggaggctgaggcgggcagattacaaggtcaggagttcgagaccagcctaaacaatatggtgaaactctgtctccactaaaaatacaaaaattagctgggcgtggtggcaggcgcctgtagtcccaggtacttgggaggctgaggcaggagaatcggttgaacctgggaggcggaggttgcagtgagccgagattgcaccattgtactccagcctgggtgacaagagcgagactttgtctcaaaaaaaaaaaaaaaaaaaaaaaattagtgaaaaaattatataaaactgtaatcaactgggaagagctttaggaagttctgaccaaaaccaaagggatgatcaatgtattatttaagttttataaattaagaaatgtatttaagtattaattacataggccactcctagtaaaactaaattagattttagtaatttccaaataaacattgtggagtcaggggtgaatggaccatataataaatacagatcagaacaaatacatgaaactttggtaaaagaaaaagatttctgggcctactacccccaagaatatgagtggatttttagcttcccactcatatttcatttaaaatacttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaaaggactgcagagtaacaatgggatgtaattcaagggaaccttatctaatgggggtggaagtgaggagctgtcagagatcagttatttgaggaagctgggtgtaagctggaacctaaaggtgggaaaaagtgtttccaatagatgaaacaacccttcaataagtgattagatttttggattgaaatgaaatggaatcctggctttactccttattacgcaaaaataaatcaacagttttaatggaaacaatttaaaggtgagatctaaatcattaatgaatttccattaaaaaatctttgggtatagaggtcttttaaagtgtgatatgaactgcagaaatcacagtggagtagcacgataaatgtgcctacataaaaattttaaagtggtaattaaacactattaaagaaggttgaaagacaagaaagaaatgaaagaaagcaacccatgaaacaaagatttactcttcctctttgcatactgaacttaatagggaataagatcaccacagaaaaatgtgttcaccttcactaataaataaataaatacaagttaagtctaggtatttttccctatctgatgggctaagattttaatctaggattatttatatgtggcacatttaaatgtccttcagaataacattggttggatatattatagtaaataactacagtggaatattgtgcaaaaatgaaaaatgtagacatttaaagacaaaggtgtctgttagatattgtctagtgaaaaaagcaggttataaatctggactagggtgttacttatatgaaattagggacacatgtctgtgtggctgtatactcatagaatgctgtctagaatgttaaccaaagtatgagagtcattagttccctgttgtcaaattttggatgacagaagtttgtcttgtcttgggagcatgaatatttttataaaacaaggtgtttagctggtttatgaattgatatttagtgttaatctcttatgctttcagtttttcaggtaaaacttggtattttatattatctttttttttttttttaaatttgagacagtctcgctctgtcacccaggctagagtgcagtgcagtggcaccatcttggctcactgcaaccttgcctcctggattcaagcggttctcatgcctcaccctcctgagtagctgggattagaggcacctgccaccgcgcccagctaatttttttgtatttttagtagagatggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagcaagtctattatgtaaaatgagacacgtaataattatatttttaagatgatttgtgcagtaagataaatgctttactgaagctaatatgtttaaattgctttaactaaaattattaataaaatgaattcatttgtataaaatacagcctacccatgtaaaatattactcttcataggtaccccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgtacaacagtattctaggccaccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaataggtcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaatcttaccagttaactttgcagtgtctaggtttgagtgtcataaatccacgtgttcctgttgcaacaaatacccaaaaattgtgtgtgcacttcctaataccagtcttcacccatggaggaacagtgctttttagagatgctttctatttcaatgttggcatactgcctgagggtattgcagttgtgggtgcattccctaatttgtatgatcaagatgaactggcccttttctacttccaagcttttaacagataccaccatatttgacagaattcccagagtgaattgcttgtgttattagtagattcagtgcccccagctgggataggcaagccatgacagcttccctgtttcacctacagaagtcttatctgagggatctattcacagtaagcaccaaggtctccatgtcttgaggtcagtttcattgtcttttgaaaagtgcatgcttcatttgaacaattcattcagcagcagatggactttcagtgatttaaaataaaattttgatccaaagctcaggacacaaaccacagtggtaaaattgagtagcatataatatcagactaaattatctgtaattttccacaacccagattgtatgtgttttatgtgtgtttaaataaatatgttagatacacgtgtatacatacacccatatacaacagatccaagactggctgacttcatttgaaatggttgaatctgctgtgtaataaagtggttcaaccatgattaggaactgaaatttagtagaagagggaaaaggagttaatgtaacaaattattttagctacaaaccccggtaatagagcacttgggggatgggatggggtgggttggtgagacaatcagaatggtaaattgattaaatgctcctaaccctgtaattttgtgcatagagcaccctatgctgtggaaataactgttcttagatttcattgtaactggactgttcaggttgcccagagggaaagaacattcctaattctaataaaataaacttttattttgttattccattagttacttatgtttatttttatagttaaaaaatgactaaaggtggctaatagccacccgtattatgtgccttattcactgttcccacttaatataaaatgtcaaaaattggttgtttctttgcagggaactgtgaatgagcccattcccccaacatttaacttggttaatgaagctttcagagcattttctgaaagatttccaatttctgcatctcagatattgaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaacttactgtctaaaacaagtggagaagaaattgccattttttataaaggaggaagataaggctcactgaggttaaataactccctcaatttttcatttccttctacctgaaacttaacatcatgctacctctttgtatcatattttgttattctggtcacagaatgacctagtattctgtaccagggaaggtagttcttaactatattgtacttttaaaccacattaaagactattataaatgcctatcactgctactgttagaggttgctctatactatctctgatctttcatttgttgcagtttgcaacacagtagttgagaataagtggtttagtatgatttgcttaatagtacccaagtaatttgcagttgttggtttagttattcaaatgaatttccattgtaaagaattttggatagtctgcaggaaattgttacaggatgcacagaacatcccatatccattggatctcagcctttgaggctttaaaaagatgataagcagtgagttttatgagaaaattttggctccttcagaaacaggaagataagtgggcccctcagatttttcatatatctttggggataaagttggttatatctggtttattttagggattttgcttctgtagttacccaagatcaaatagccaactcagaaatactcagttggatatcaatcaaatagtgcctaccaggggagtaaacagacaacttttaggtttttagtttttgcttttgtgtggagttgagtccaatttttaaggcaactattgttgacctttctctaggcggtagcatttaggatgggaaaaaataatatgagttatgtgcgaaaagcagttttcaggctatcatttagggccacagatatgcttatttaggactattttcagggtaggagccagttaaagtttgtatatcagtcacacattgatatgtagcagctctatcaataccacaacaaccttattaccatagtaattcaggggtctcaagtaatccaggagtctcaaactgaaatgtcaacaagagccaagtaaatattttagaaatagagtaccctggagtagatgggctctgagaggagcctgtgaaatccagacttcatgtgaattctcttaattaaatgtgggccaaagaaaacccggccatgggcagtttttttttcccagcttctactagtcttggcttgcaacaatgccactgtccatctggcattacctagaccagtgatacttaaacttgactgcgaattggaatcactgagaagctttaaaaaatattagtgcctgagtgttactttatggagattatgatttaattgctttgggtaggcatcagtaatttttgtaaagccctttacgcattctcacccctaattccagccggtgattctcacatgcagactaggttgagatccttgatctagactgccttctatagttgcaaaaagagaatataggcgagcaactccagatcataagggacaaaatgattcaaggcaaattgactggctcagaatagggcctcactggaggccctagttgagtgggttttgtggaatggtgcctcccaagggtctggtgtgcagtgcccaatttggttttttgttggttttctggtaagtggtccaccttggagaaaatcacaaaactaaaagtcttaccaagaagtagaactgacaagcagccatgttgattggcagtacattctcttaccaagggggagaaatctatctagggaaaataatacagagtctgagcaaaggaagttgagtggttataagcaaaactgtcattaaagctagttgcgtcaagtctgcacaattccacgagcacttaagagtttacaagtttctcatgtctatcattcttttgataatcttgtatttttatttcaagtgtggtatagtagtaagaatattggtatttctcagccatagatttcccttttgtaaaatgggaatactaataggaactgtaatttgttgagtgctttttgccagatgccttacttttgtctgtatcttccaagcagccctaaagcaaaatgggcattgttaccctatttttatgaggaaagacactcatatactactaacttactcaaaagttacacattgagtgtataacagggccatgcttgtctgattccatatgttcattctattatgctgctgttgtctgttacataggaatattgtgaggatcaaagaacatgtgaaaacaaaacctagttacaataataagcacaccagtgctaacttgggcaaaagataaggatacagagctgtctcagagactcccaaaggcaggatgagattgggaactagaaaaccattttggacccctaaagtggtattgtctactatctgtacatcattctcttacagctcttactgctgcttttcctgtcagttaccccatagctccaggtattacatgttaactgttcctgacacatgtagacagaaccaatcagatccatggggcaggatcatcaatacaaacatgggtgttgagagcttaacttaatcgggaaggagatcttggagatcatagttcgctgggttcacatcatggaaatcgtctttgacaaaactgaaatgccctgaagttttaattttttaaatacatgtaatgaattggtatatggtagatactcgtggctacttagtatttaccaaatgctttgtttccatctcgtttatttttattttttatttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactatttttttagaggtggggtctcactatgttgcccaggctggaatataatggctattcacaggcacagttagggtgcactactgccgtgaactccaggactcaagccatcttcctgccacagcctcctgagtaacctaggactataggtgcatgccaccatgcccagctgacaatggctttatatacataatatttcctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtaattccagctgctcggaaggctgaggcaggagaatcgcttgaacgcgggaggtggagtttgcagtgagccaggatcacaccactgcactccagcctgggcgacagagagactctgtctcaaaaaaaaaaaaaaaaaaaaaaaagaagaagaagaagaaatacaaaaccaactctttatagtagacagtttatcccccagaaagctttttaggctgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatgaaataactgattttaatttacattacatttccctgattaatgagttgagcactttttcatatgcttatttttcatttgtatatctttcaagaagtgtctttcatgtcttttctcattttaaagttgggtgtctttttattgtaggtgttattctttgtattttgaatataaatcctttgatagatatgctatgattttttaaagactctatgtattcacttattgggatctttcgatgaacaaattttttttataaaatccactttatcagttttttattttatggttttatgacctcaaagtcacaaagaatatattttcttctagaagttttatggtttgggattttatgtttaggtctgtgatccatctcaaattaatttttgtgaacagaatgaggtttggtttttttccaacatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtcaaaaaaaaaaaagaaaagaaaaaactgctagaatcttgatatggggttttgttgagtctataggtcaatttagaatgaacattttaatagtattgagtcagctaattcatgaacatattaagtcttgtcatttatttaggtattaaatttttttctcagcaatgttttgtagcttcccttgcgtaacacttgcttatcttacattagactttttcttaagcatttgatttttaaaatatttttgattttcttttctttttctttttttctttttttttttttgagacggagttttgctcttgttggctaggctggagtgcagtggcgcgatcttggctcactgcaacctccgcctcccgggttcaagcaattctcctgcctcagccttttgagtagctgggattataggcacacaccatcatgcctggctaatttttgtatttttagtacagacggggtttcaccatgttggtcagcctggtctcgagctcctgacctcgtgatccaaccaccttggcctcccaaagtgctgccattacaggcgtgagccaccgcgcctggctaattttcatttttaagttgtttgctgctagtatctagaaatacaattgattttttgtttgtttctttagagatgggtctcactatgttgcccaggttggtcttaaactcctgagctcaagggattctcatgcctcagccacccaagtagctgggactttattcacgtgccagtgtgcctggctgatttttgtatgctgatcttgaatcgtgccaccttgctaaattcatttattctagaaatagttcttgtagactccgtagagttttatattaaatagatacacaacagtgtagtctgcaaataatgtttttacttctttttctgattttatgccttttcttctttttttttttttttttttttttttttgtctttctccactggctacaatatctagtgcaatgtttaacgtgtggtgagagcagacaccttgccttgttttcttaatcttagggataaagattttaatgtttcatcactaagtataatgttaactgtaagtttttcacagaccagcccaaagaagttcctttctattcctaatttgttgataatttttattaggaagggttattaaattttgtgagatgcgtttttagcttttaataagattattatgtatttctctttttattttgttaagatggtatgttacaggggttggcaaactgtggcccatgggccagatccagcccatggacagttttgttgttgctgttttagagacagtctcactcttttgctcaggctgccaggctggagtgcaatgacatgatcatagctcactgcagccttgagctcctggactcaagcgaccctcctgcctcagcctcctgagtagctaggaatacaggtgcatgtcaccacaccaggcaaatttaagaaattttttgtagatcttgccgtgttgcccatgatggtctcaaactcctggcctcaagcaatcctcctgccttggcctcctacagtgctgggattagaggtgtgagccaccacacttggctctcatggactgtttttgtttttgttttgagacagggtctctgtcacgcaggctggagtgtggtggcatgaacgtggctcactgcagcctcaactttcttggctccagcaatcatcctgcctcagcctcccgagtagctgggaccacaggtgtgcgctaccacagctggctaatttttctttttcatttttgtagacatggagtcttgatatgttgcccagattgatctggaactgctaggctcaagtgatcttcctgccttgcactcccgaagtgttggcattacaggcatgagacacagtgcccagcctattgcagtgttttttgttttttctgttttttttttttttttttcatctttgtttttgtttttttgagactgagtcttgctctatctcccaggctgtggtgcagtggtgcaatctgcaacctccgcctcccaggtttaagcgattctcctgcctcagcctcccaagtaagtgggattataggcacatgtcaccaagctcagctaacttttatatttttagtagaaacggggtttcaccatattggccaggctggtcttgaactcctggcctcaggtgatctgcccaccttggcctcccaaagtgctgggattacaggtcactaggcgtagtagggctactacgcctggccctactgcagtttttaataagagatgagttctctcagcttttgtctataagagaatgtccttacttttatttttgaggggtattttagttggatataggactctatgttgaccttttatttcttctttcagtactttaaagaagttattttattgtactcaggcctcatttgtttctggtgagaagtcattcatcattttaatttttatttcctttccgtaatgtgtggttgttctcaatggctgcatctgtgcattatatttacttttcagtagattgactagggaatgtctaggtatgtttttctttgtatagagtttactgaacttcttggatctgtgttgatgtctttcattaatattggttctttcttggccgttatccgtttacatttttctcttgtctcatactctcttgcttctcctcttctttggagattctagttacatgtatattagatgatttgatataaacctacagatctcagatgatttttcccctgccctgttttctttttgttttcagtttggatactttccatttaaccatctttaagttttttgatgctttccaatgttaacctgttaaacttgtttattgaattctccatttaaaaatttttatttttagttatttatggatacatagttgtactgaattattcatttctaatatttttatttctagcatttcattatatttgtatagttacaattttctgctgaaatttcctatttcttcatgcatgttttccacattttccattctactttttagcattttaatcagttattttattgggttttttctgttttttctttcatttttaatcagttattttaaggatccaaactgataattcaacatctgggtcttttctagttctgcttctattgagcccttcctctcccttaccatgaatcttattttcttgcttttgcacgtcttgtatatttgattggatgatggacgttttatgttgaaaaaaaaaagaaattgaagaaaatgtttacttccaaaacagagcatgccctttgtttttttttcaggccacttgaatggtggctcaatctgatgtatatgaattctagactggggcttcactgcagttttagtttgattcagtttgcctctagcttcaaatatttgaaggaacgtagaatcagaactctcatatcaccagggcctgagttttgggcattggcaagattccagagatctgactttgcttcatagctaagccaccagcttttatcaatgtgggagatctttccctactttacaaccttgctgccaggatttttttttttaatcaatgggctggggataggaggatctttctcagctctcatgtgtgccctgcccttttgtagaggaatgcccacaatgcctaggggatgggtttctcagcatttctgaccccatttaggctccaagagtgcctctgttggatttcacaacaatcctgcctcccctttcatttttaaagggtattttgcccttgggagaagtcaagctctctcagcgttccttctattatccacacctttagtgtactacaccttcctgtacctggttatcatctaaggggtaagattggtgggaagccttcctctgtggatttgggtcatctaggttctaatgtcaaaccagcctccaaggggttgtgaaaatgttgttaaatttcagcaggtttctcttttctcccccctgtagtattcctcttcctaccatagttcaactaggaataacaacagctagggggtctcttctctcctatgaaggacttggcactttctggagtttggatcatttaggtttctttggtttttgtttttattttgagacagggtctcactcttacccagcctggagtacagcctgtagtgatctcagctcactacaacctctgccttcctggctcagttgatcctcccacctcagcctcctgagcagctgggactacaggcgtgtaccaccacacccggctaatttttgtattttttgttgagatagggttttaccatgttgcccaggctgatctcaaacttctgagctcaagcgatctgcctgcctcagcaccccaaagtcctggggttacaggcataaaccactgcacccaacctagatttctttgtgtccttagctttctgatgaattaaacatatgttttattttctagctcatctggccttttgttgttgtttgctagagtgggaggtatattccttgtgactttgttcatatcactagtgaatttcagaagtaggagtttatttttttaataaaaaatttttttaggtcaggcacagtgtctcatgcctgtaatcccagcactttgggaggccgaggcaggtggatcacctgagatcaggagtttgagaccagcctggccaacatagtgaaaccccaactctactaaaaatactaaaattagccaggtgtggtggtgggcgcctgtaatcccagctacttgagagactgagtcaggagatttgcttgaacctgggaggcggaggttgcagtgagccgagattgtgccactgcactccagcctgggtgacagagcaagactccctctcaaaaaaaaaaaaaaaaatttttttttaaacacgtctcactgccacccaggcttgagtgccatgacatgatcatagctcactgctggcttgaccttctgggctcaagtgatcctcttgcctcagcctcttgagtagctgggaccacagtcatgtgccaccatgcctggcttttttttttttgtagagtttgggtctcgctatgttgcctgtgatcctcccaccttggttttccaaagtgctgggattaaaggcatgagccaccatgcctggttaggaatgggagtttaaacaatggttttatttacatatttcattagctagtatttttttcttttttgagacagagtctggctctgttgcccaggctggagtgcagtggcacgatctaggctcattgcaacctctgcctcgtgattctcgtgactcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactatattttctacactttatttgttttatgtaactattttaacaacctgaggacttttacaggctgcataatatgtcttaatatggatgtatcttagtttatttaaacagttactggtgatggacatttccatgtttccagtattttttctcacaaacaatgcagtattatgcctttgtccacattcaccattgattgctattgagtatatctgtagcatcaagaataggcatactgaaaatcctccatgaagtccagtgaagcttcatattattttgaagtgatatttcccagtgttggctggactctcaagcgtttgtggtataggttttgggaggactggacacttccaaagagaaataagatgttacagacttgtccagcaggtggcatcagaacaaagctggctatggaccttgtcagtacaaatgataaaacattaaaaatgtaaaaactcaactgtagctccttgtttatacatatattgggggtgttgaaaagttaccgatgcctgattcctcttctatgtcctcagcccccaccataaaaatagataaatgccattttttttgtatgcccagcacagctatatgatttgaataatcttgataagcagggtcacatttgaggagatttgctaagggaaatgaagatccatctgtgacacaagaaacatgttctatgtgatttctgggattttcctgtgaacatacttcttgtttgtttgttttacagtggatctcactctgtcacccaggctggagttcagtggtgcaatcatagctcactgcaaccttgagctcctgggctcaggagagcctctctcctcagtctcccaagtagctaggactacagacacatgccatcatgccaggctcattttaaaattttttgtagagacgggtctcactatgttgctcaggctggtattgaactcctgggctcaagcaatcctcctgcctcagcatctcaaagtgttgggattacaggtgtgaaccatagtatccaacctattatgtttttttaaaaagagattgttctaattatgtatataattaaagtacattaggtttagtgattgcaatttgagaaaccaatgtcctttcttattgaaaaaggccctggtacagaaagtgttctatcttcctcacaagatctgaggtcaaaggagagattttgaaacattatagcaatggcttctagttattgaataaagaatgtcatttgctcctcacaggacccctttcagggagatttcacatattgggaaacagcctcatgagctttctacaaacatctttgtccttaagtcttcccatttcagtaattggctgtaccactcatccagcagctttcaaagtaagaaacctggcaatcttcctttaacatccatttccctttccctcattcccccatatccaatcatgtgtattggaggtttttccacctctaaacttgagaacccatttactttttctccatctcctttgccatcacactagtccaagtgaagtgtttcatcatctcatttgcagcatcctttagtttaccctagattatcaatttttgtccccctcccaattcagtctctactcatgagctaacatgagtttattaagtgttcattctgaccatgccattccttgctcaaaattctctagtgccttcccaatgcccttaaaataaaattcctcatatggcctttgtggatctgcactcctacctcttctcctattgcaaccaaccctgttacctttttctcttttcacactggtcttcattctgtgctgcaaactggctgagattcttccatcctcagggcctttgcacaagttcttcctttgccttagaattctttcctggcctgcacatgtcttcatcccctttccctaagctaatgccttaccctttaggtctcattttaaacatctcttacccaggaaaaatttccctgtccaaacaagtctagattggctccccattgtttgttctaactgttctatatttctccttcttagcatttatcacaattcttggtatgttgtgcttttcactttcttagtcgctattattggagtaggtaatacatccatatagtacaaaattcaaaatgtattaaaggtatagagtaaaaagtcttctcttccctgtccccccgctacccagttctcctctttagaaccacttttagcattttgaatatccttccagaaatattttctaagtatacaagcaattatgtatataatattcctctttatttttgcctttttattaatacagatactatatgcattttctgcactttatctgttaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtctcgcccttgcaatttagatgtacaatctgcctcttcagtggtttccacaccaaaaaatccacaggctcctgaattttatatgggcctaagagtcttactgaaaattggaagtcttaaggtgtagtctattttatgcagtgtgaggcctttcatgctctgaaatgtaccactcttgactgactttttcttcttcaccctgtccggcactgtgcccttattagccagagaaatgttccccctttctcccaggaaacgttctgaccttaccctggtccctcaaggactctccttctcccccaaattaactttcaaggagtttctccaacccaaaatggcacccttcctgaaaagatttctagtggatactgttttctgtacctcactacggatgtattttgctgcttggctccccgtctccattttgctatggcaaacatttttttccagaaatatatcagataaaatgaacatgtggtcccttttgttgatttttgttgggatccatggtattgatttcttctagtttagataattccaccgtggcaagcttttattcctagcatagcgctcatgaggagaatgttagtcacttggtgttattaatgctaaaatagtaaacaagaacacaaaatttgctagattagaagtggattttttttccaggctgggcacagtggctcatgcctgtaatcccagcagtttgggaggctgaggcaggcagattgctttgagctcacgaattcgagaccagcctgggcaacatggagaaaccccgtctgtactggggctaattttaccaaaaaaactagccaggtgtggtggcacacacctgtggtcccagctactggggaggctgaggtggaaggatggcttgagcctgggaggcagaggttgcagtgagcctagttagtgccattgcactccagcctgggtgacatgtctcaaaaaaaaaaaaaaaaaaaaaaggtaaggaatgaattaacatgaatgaaaaaggcatgatctgcagtcagtcacccatggtcaaagatagcagataccaattcattctcagagcgaaacgaaatcagcccaatgcttttggcaaactgtggttgcctccctgtcatcatcatctgggctcactgtggctcgcccttctggccttgcttctgaccttgccatctctggggaggcttctttgcaagcccaagcttgggctccccttctcagaaccatgtgcatacttgtcctggaactgtttttttttttttttttttttttttttttttttttttgcctgtgcctcttggagggcaggggccatctggcacaaacctgcatccccgcagttgctaaattaatgaacaaacaaataccaagtctttcacaatgtaacttgagagtggaggtagtggtagtggcaactccatctgggggatgagagaaggtggaggctgagttttggggatggcttgcaacagaagaggagagattattagcagctaaaggagtggccagggtgaacaccaagcattttcctgactggggagctgtgggtttgtttatggctgggtaaggggtgaaaccagtgagcaggagagatagctagtactggactggagtgaaaggcatctgtagaggcaggagacaggatggggaggtagaggagttggcctaggacaggacagcacttatttgaagactggtgggcaggaggaaaggaaggagagggattgagaaatgacctggaggtcctcagtcagctgggagaagacctggaagagggggattggctgctgttgggatggagaggagggccaggggaggcagtgactcacacggagggaggctcggggatggggactttggcagtggggggtgggaaagacatactcgcaggggatcggaaggccccgtggcaactttgtgtaagtcctggttcagtcaaggagaggaatccgagggaaatgcctgattggacccatggcccactctgagagaaaggggtactgtgggtgtgcaggaggaagagcagctgggaagtaggagtgcctaggactggatccaactggaaagggggcagatatgctcccaggatcagggtagggaccctctaggaagggggcgttctgagagggaggttgtggggagcactgtatgggggtccttggaggtgatttctgggaaggggaagtctggggcagggctgtgaggagtcaggaaagaaactgtggagtccgttcctcacccacctcctgagccctggggtctgaggcccccaggaaagagggttcagtggcacaggagggtccagggcaggagagagaaagcagcctctcaggtcttcttggaaaggaactctgaccaccagtgtgaatagtcttgcagaaagctaagcggacaccaagtgaaagctggcccctcccctctcccagagtgggaggggccagcggttgcatgggcagctttccttgtgatgccacagtcctctggacacactgctgccttgccacacctcctttccctttcatctttctcatcaaccaatgggcttggcagcattgaggccatgcccctattctgtgttctagtgtggccctggttatccctcctctgactcagttgcacagctacctggcaggtgaccggaggtgtttagcagtcttgcctggattgcgctgatgtggccccaaccccgcctccctccccacaccaccatgtaggaagaaactcaacagagcaaattggctgcagccaagaaaaaggtaaaaaccaccaggtcatagcccctgacccacctgcagacttcctctgacggcaggactactgccagagtctgtgccactcctgaggcacaccgggttaggcccccctggtgcctctgcactccccctaccaaaatattgttagccagcgctgttccctcagcagcccagcccctgccctcaacagtcaccccagggtgactactggggcaggtgactcctggggctccctgctccagactaggccctgacctcctgccccctcccaagcctgacctccctgggctctttggcctggcatctccaaggactaagacaaccacttctggtggttgccactcacctggggatgtgagttttggctggccaggctcctggggacagggggcccaaggggcagtagagggtaattgttaagattgctgggtactggttaaaaattctgggtttgaatcctgcctctctgtctgctggggatatgatttagggcaagttacttgagctctttgggcctctcttttcatatctgtataatagaggtggtattgtttgacttccatttgtgaagtttaaatgaaatttgttgttgtttttatgtgaatccctagtacatagcctgctgtaaacacacaggacacccaggaaatggtcattgctgtttgattttcctcgccccagtctcaaggggaagccaggccaatgagaaaagccacttgccatcagcctatccctttagaagtcactgaaagggccccacgtgtggtgtaagagaagatcttacttgccaccagcttgctgggtgaccacagaaaaatcactatttcccctgagcctcagttttctcctctataacatgatactggataagatcagtgtctttcaaacttgtttttcacctggagtcaccttagctcaactgaacccttactcagaagtctggttttttttttaacagaagtggaggtctggagctctaccacattcatcgcccatgtcctgggcctgaggagaggggtccagtgagcgtattgagaggtgcattggtcagctgactccactctgtgactgcgtcactcaggggacttttccatctatttgttcctgcccctggcaaggcagcaggtggccatttggaagaatggcacaggccatggttttaatctcctctgctcttcttcagcgtttcctttccctgaatccacatctttctcctaccctgactttcttgcttctctctaagccacttctgtctttctccccctgcccttgtttttcccttttcatctcctgtagattcaggacattccgaaggtgctggtgtccaaccttaactactccaatggggtagcactcctcgactggacaagtggaaggtgaggcagtgcccagacccctctctggcttgctgtctccagctatgcatgttcctgaggcttctctggtttgggggatactttgcctctggcttattttatgttgctgccattaaccttcagcctgtttatgtctgcttcttcacttgcttgattgattgagtttttttcctttccagcatcttttatcatcttggaaatggtgagacataccttaaagtttaaaagtaatttgggaataatgtacaaagcaggaatatgggatttggggctttttttttttttttgagacagagtctcactctgtcacccagactggagtgcagtggtgtggcacaatctctgctcactgcaacctctgcctcccaggttcaagcgattctcttgccttagcctcctcagtagctggcattacagacacctgccaccatgcccagctaatctttgtatttttagtagagacgaggtttcaccatgttggacagactggtcttgaactccttacctcaagtgatccaccagcctcagcctcccaaagtgctggagttacatgcgcaagccaccgtgcccagtcccttgctgtttttatactttctctatatccataactgtttcccatggaagtttttgtttctttgaatttctcatttttattacccctgcatcatctgctaccctaaaggatctggaggtaagaggccctaggctgaggtgcagtgaccctgcaggccagccctccaacctcctctcacagtgggggctgggtgcccctctgccagctgagacagcccacacacaccccagccctaatgattgttctctctacctctccctgcagtcctcctccaactcctcctctctgtatgcacctcagagccggtaccaagaactagcagtagccctggacttgagctctgcaacaatcagtcaactcattgaaaacatagtcattggtaagagtccagtagagtcccctgattccactctgccaatcctgggctccagtttccccttggggccctgaataaaggggctgggggcccctggtgccaaggacaaatggagagctggggtgcccatgcctcacctagagggaccccagagcaaggagcatgcagcatggctcttccattgctgccctctttgctgactctctcttcttcaggtacccctgctccagtccttgccacacacgccctggggttgtcacctctcagggaagcgctagcctgattggttgtcaggggccccatatttctgccctgactcagtctctaatttgcccttgagtctggacaagccacctctcctccttgggcttgtgtttccagaggaggtagagagtatcaaaggtctctgttagctctgagagtctgagatttaaagtcccctagaatggaaacctcagggcgaaggcctcctgtctgtccttttctgtcctgtatctctgttgtgaagaactgtacctggcctgtgtgtgctcagtaaatgttcattgaatgaacgcacctttctaaatcacaagctggcagaagggtgggcctttctcagactccgtctctggaggtttatgttactgtccttttgagagaatccagattcagactttgagttctgtggctgtgggcaaaaaccaacaaagacccacatcctgtgtccttgggagcttgaggagagttgaccagtttgtgttgccattgggtctgagaactttgcctttaaaatccattcctggcccctgcctaccgcttcctggtctggggaatagagctgagggggccaccctcagtcacctgaatttgactctccccacagaaacagcagaagaaacaagtggaacatcagctggaagaagtaacatgatttctttctttgctcacgacataaatgctgggtttgggggacaatcagatgtagaggtgccagtctcgtgtcgcccacttccagcctggggaagaaggctcacccctcagattccaccccatcctcccaggttatcccgataacctggtcccatgggtgggcctgtcctggggcattggtggcattctgggggcatgtctcttgctgtgccatctctgcctccccctggtaagagctctgtcttcctcttcctgtaggaaaagaaaaccaacaatgaaatacacaaagcacaaatggagcagttagaggtgagtggagggtggggagttttctcctgtcctctggagaatgtttctttccttctctttcagcacttgcttggcttttctcccaaaggttcaattccagacaatcaacatcctcatgttggaaaaagcagacttgaagaccaccctttaccatactaaacgtgctgcccggcactttgaaggtgggaatctgggcaccccatcatccttcaacctggcactttgacaggtctttagggggagtcctttgggccccatctcaacctctttcattacagcagaatctaaggatctggccagccacctgcaatattccttgcagtgtattggagagttggagtgggctctctgtgctgtgtctccatgcagcagcaggaggaggacagggtgagtccaaccagctgccccatcccctggcagcctggcttcccagatagaggagtgagcctaaaggtcccttctgcaggatggagtgtcctgcccagaaggcagcatggtcatttctcgctgcttttgtgtatggttgttagaggcagcctggggctgagtcagctgctgtgggtgagttggggggcactgtggggagcgagcactggatgcagagctcagaggccacacagcagctccagaactggatggtgaagatgagaagtttatatctggggagcccaggccattctacacagtgccccttaaaagggcaaggggtaggctcaatatacaactcggtcggtaaagatcaagtcatttccaagcctgtggtctggtttttaaaagaactgttccacacagtcctgaaacaggagaggctgcgggagcaggaggagaggctgcgggagtaggaggagagactgctggagcaggagagactgctggagcaggaggggctgcaggaacagggggagaggctgagaaagcaggaggagaggctgctacagaaggagaggctgctggagcaggaggagaggctgcaaaggcaggaggagaggctgagggaagaggaagagaggctgtgggagcaggagcagaggctgagggagcaggaggagaggctgctggaactggagcagaaagccaagctctgggacgagcaggcagagacacacatgcaaaccatgcggaatgactgcaccaccatcagccacatgctctcgcagaaccacgagcttgataagcagctgggcgagccacagtacgacttccaggagctggtgggttgccccacctggggagcctgccttcctccctagccctccaggcctttgtttccccacctgtaaaatgggcatatgtagccctcacgtgaaatggtacttctaaaggaacctgtgagccagagccctgctctgatggctgtgagagagagggaatgatttttctaacttgcctccacccttcccggtgacatgggaggcagacatcaagttctggggtctccagctgcagtgggtgaccgctgattgcttctctttgtccagaacaaagagagcaagggcgcactgcagttggagcagcaagtaaagttgctgcaggagaagctgggtgacctgaaggagacggtaacctccgccccatccaagaagggctgggaggcgggcaccagtctctggagaagggaagtgtgaggccaaaggcagctccagcctggaggcaggtgacgccagcacccttcagggcagtcctgtgactgtttcttgcttcctgccctctgacttttagaggtaggtagccctgggctcctcccaggtctggacatcatcatcccagctagaggcatggagcccccaatcataggggaagagacagtggtataagaggctcctttgctgggggcagtagctcacgcctataatcccagcactttgggaggctgaggcagtagaatcacttgaggtcaggagtttgagaccagcctggccaacgtggtgaaacctcatctctactaaaattacaacaacaacaaaaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaataaagcctccttagattcaaactggattctggcctgggttcctctggtcaccgttcaactacttttcatctctaagtctctgtttctttaacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatttgaggctgaggaaggaggcatggagttctaggcaagggaggaattctctaaggcctggagcaagcggccaggggcctgggcaggtgacagagccccacggtgccctcgctaccctattaatgggcccagaatctggaagccagccaccatgtgccctcacgcccagggtcttcctgcaagtggagctgaagagccaagagtctcagagtctgcagcagcagcgagactagtacctgggtcacctgcagcagtacgtggccacctgtcagcagctgacctctgagaaggaggcgctgcacaggcagttactgctgcagacccagctcgtggaccagctgcagcagcaggaagcttggggcaaaccgatggctgagatggcccaccaaaaactgcaggagactcaggggagggagttgctgaggacggggccccaagagggatgacctgcatcttctgtgccttctcactctctttcctggccccttaggagtgcctagaagctgccagccagcagaaacagcagctagaggcccagttgagcctcatggctctccctggagaaagtacaggagatcacttagaggaagaagagagagccccaggaggaaggaggggggattgttagcagcataggactgaggagttggaacagacctttagaacagctagtcattatgccgaccgggtgtctgcactaagtttggtatcaatatggtgacctcctggggagcagggggccaccaggttgcctaaggatgggtgaactggcccagatcagaaagggagcaggtcagaactcccacactgactggtagtgggactgtgcctgggaaatataacaagatcttggttcttaaaagtaaaaataaaagtaaaaaaatagtaaaaaaaaaaaaaaaaaaaaaaaaaagaacagcagctcatttccctctggggaggggctggctcagggttacacagtgagggtgggggcagaggtggccccacagtacctcccttgttgggttgtctgaagacccctttggccaaaccctacagatggaggaggacatctggacagtgaggaggaggaggtgccttagccccttccgagcatcctggaggacctggagagccgggaggccatggtgagctgactccccctgcacctcctttgccaccttcctctgtggtccctcccagacccccttatgctcttcatctccccaccgtctgatttctctggaccctcaccccttccgggagccagtgatcagacaccatttcacctgtgaccaacaggtgcactctctgaggccccaagggaaggggctgcactccaccaccctgccctgtttgttctgtgtatgcccctacaagaagggcatcagggtggccaggccatgcagccaggctccagacatccccaggatctcagcccctccaagggtacctggaacattgaggcacagggagaagcaactggccagaacacacatccagctccccacatgctctagagggtttcaggtctctgcctctcgggaccttgggctcccccgattcagcctcgtcttagttctgactctagtacccataatttgcctccatttcccaatccagaaattggaaaggaacatctccatgtcccttgcttgaagacctggccagagctggtgccaggctacagatgcctggcaggaggcaagaagggcacactcactttccctttgtcctgggaggcccacataccaacattgccaccactgctgccacctggaagcacaaccaaactagacacaggaaaaggggaagggttgagtgaacctgggacactgcaccccaactttaatgtgttgttggattcaatttgctaatattttgtggaggatttttgcatcaatattcatcagtgatattggcctgtagttctctgttttggatgtatctttggttttagtatcaaggtaatactagccttgtagaatgagtttggaatagtttgggtaaggtctctagttttggaatagtttgagtaaggttgatatgagtttttctttaaacgtttggtagaattcagcagtgaagcaccaggtcccaggcttttctttgctgggagactttttattaccatttcgatctcattgtttgtcactcgtctgttcaggttttggatttcatcatggttcaatcttgataggctggatgtgtctagaaattgatccatttttagttggttttcctatttctttgtatatagttgcttataatagccactagtgatcctttgaatttttgcagtatcagttgtaatgtttccttcttcatctttgattttattcacttgggtcttctctttttcttaggctaaaagtttgtcaatgttgtttatcttttccaaaaaccaactattcttttcattgatgctttgttttcttcatttcaatttcatttatttctgctctgatctttattatttcttttcttctagtaattttgcatttgctttgctcttgcttttctatttctttaaggtgcattgttaagttgtttatttgatgcttttcaactttttaaaagtgggtgtttatagccataaagttccctcttagtactgcttttgtcgtatcccataggttctggcatgttgtgtttccattatcatttaagaaatgtttcaatttccttcttaatttcttcattgacccactcgtcattccagagcatattatttgatctccatgtgtttgtatagtttccaacatttctgttgttactaatttctagttttagtccattgtgatcagagaagatgtttgatattatttcactcttttgtaatgttttaagacctgttgtttgacctaagatatggtgtatccttgagaatgatccatatgctgaggaaaaaaatatgtattctgtagcccaagggagaagacacctgcccccactctgctgcaacacacagcgctctgctcagggatggggcagtggagtgctgttgttacacaaggggctctctgtcggggagggaacagaaatctgttctgtagtgtttgccatttttggtggtgcaaatattccatggctgatttcaaactgccaccgtcttctcagcctgggcttgtttgtacccacccttgggaaggctatccaagtatttgaaaggatgtgggtgttgtgatctaaagtgtatctttattagatacactccagcccagttatgctatggttcttgcagactcatagaggaactgccttgttggtctcagataagatctggaagaattctctgggctaccaggtagtagagacccttattctgtacctgtagtttctctccaaaaaacagtctctctctctccctctctctctctctctctctctgctgagccacttggagctgggtgtgggctgacacaacatccctatggccaccaccaccactgggactgcactgggtcagacctaaagccagcaaagcactgggtctcactcagggcccgctgtcaacactacctggctgtcgcctatgttcactcaaagccaagtaactggggctctacagtcagcaggtggcaaagccagcctggcttatgtctttcccttcagggcaacgagttctctcaggccctggtgggtccagagatgctgtctgggagtcagggactacagtcaaaaaccttagaaacttacctggtgctttattctaaggcggctgggctgacactgaaaccatgagacaaagtccttcccactctgcctttcccttttcacaggcagaggagcctcaccctgtggccaccaccacaggcccacagggagtgctgccaggctactgtcgatgttcacttagggcccaagggctcttaagtcacttgtggtgaatgcttccaggcctggggctcacccttcagggcagtgggcccccctctgtctcagggcaggcccagaaatgctgtttaagagccaaggcctaaaatcagtgaccacaagagcccatttagtgctctaccccattgtggccaggcaggtacctaagctgcaagacaaagtcccttttacctttccctctgcttttctcaagcagaagaaatctctcaccacagccaccaaagctgtgaatgtgctgggtctcacctgaagccagcatgtcgcagagccttactccaggcctatagcacattacctgggtatcactgttggctattcagggcccaagggctcttgagtcagcaggtgatgaatcctgccaggactagaatcttttctttaaagcagcagattcccttctggcccagggtgtatctagaaaggtaattcaggagctaggtcctggaatgggggtctctcaactctgactggggctgtatcctactgtggctatccaagacgtaagacaaagtcctctttactcttccccctcctctcctcaagcaaaaggaaagagccacttttgttgctgcaagctgcactgcctggggttgggggaggggtggtacaaacactcccttggctgtcctggctggtgtctctctaggtcgtgtgcctcttgagtccactggctctgagcccagcatggcattaggatgtgcctaggagttgaagtccttatggactagactgctttcaagtttatttaggaccctggggcataatagcctgccatgccaaggcttgtcaaaacccaagcctcaagcctcctaactactgggatgggtgaacccctctgggtagggctggtctaaatgctccctccatgggcaggtgtcacgtgagttccacctggtttcgctttctgctgtgacagggcagcactgagttcaaggcagagtcccacagttgctgcattctccctcccccaggtgcacagattctcagcaccacagcgaccactgctgggggagggggaggggtgatattggtgtttcaaggctgtctctcctaccttttcagtgcctctttcagcgacatgaagttaaacccaggtactgtgagtcctcgcctaatttttggttcttatgatgatggttttctggtggaaacagttgttaaatttgattttcctgcagggggaatgattggtagagactactattcagccatcttgctctgctcctcctccctcccttcactttaattacctcctaatagccctatttttaaatacaatcatatagggggttagggctccaagtatgaattttgaggagacacaattcagtctatagcatttggacttgggaagagggaggaaaagaacacgcacaggaaagtcacagtgtaagcaacagtatggaggtgggaaagttcagctcatggataggaaaaattgatccaagttggcagggcccacagggagatgtggtggggtggtgagtggcggccacatcaaaagaaccttgaatgccaggctgaggtgggaggcatttcctgttgtgtggaatgtgccatgaggtggtggggagggtaacgtgatgaaaggacatttgggaggatggatctggcatcagtgatgggtgggggtaaggagtgaacaaagctggaggccaggaaaccggacacatggcccagagttcaggcataggctgttcaaaggcagtttccacactgagttccaatgtggatccaagcatgcagcggatatatttggaaaagcaaaagcattcccttcccattaccacacagtttcccagctgagttcatcaccagagtcctacacatcagacagtcaacctgccccaaactctgtccctagaagctgtggcccagagggagcccttgtccagctgtagcccggggacgctgcagcctgagcaggactgcacctgttccctcccaggagcctcatctctgtccggcctggctttggcttcagatgccctcagctttggcttcgaaatctgttgggtcagattcacgagagctctggccttctttgggttgggaattttaaatagttttttcaagcaggcagtagatcaactctacttgcttacttctgggtgcatctcctgttccccggccccagatcttctttttccttggtttatcctctcattgtgttgcagcacatcttccagtggcttccagagaaacagtgaatggaagccaagctttctgaccctcacatattttagaatgtcattgttctaccccaattcctgattactagtttggctggatgtaatgctctaatttaaacataacttctcttcacattgggaaatattgctctattattttctagttcccagtgttgttgggaagaagtcagtgtcatgcggagtcttggctctttacatatgacctgtcttttctctctggaagattttaggattttctatctttgggttcttggaatttctcagtgatgtaccttgttataggtctttctacctatactgtgctagtcacttggtagactcttgaactagaaaattatgtgcttctgtggggggaagccaccagcatgtttgggtcctggtttgggtcccaatggggcacatgtgggaaagaccatgaatgcccatgtctccgactagtttccccatcagaagtgttgttgcaccaatcatcctcctccattaaaactggacagactaagggccactttcctaatggatgggtcttcttggttcatctcatgctcccaacagagctccctcccggggatgggaacgcgccatgccaggagagccctcttgatccagcctccagccaaagccagtccccctgccaaacaggccctagagttacactggagggtgacaggcctaacctggaaatttcttgctgaaaattgtcagtttcccacacaagtacagcctggcagttaattcaaattcaaaccagaagactgctgcttcagtctcgactgcttgaaaattaggttgtgtagagctttcatttgctggaaattgtgcagccagacattgtgcagattgacccagtagctacagcaagtacacacatagggcgccaagcaaggacaagtgtgcacatgtgcgcacgcacacacacacacagcagaaaatctagaaataaactattttaatgtcagctgtcatggaagttttgtgtcatttccccaaaaaaacacaaattttattttatgatttagtctagtatttatttagaattacttaaggaaaaggagacgtgagtgcagtggctcatatctgtaatcctagcactttgggaggctgaggcaggaggatcacttgagcctgggagttcaagaccagcctgggcaacatgatgaaacgccatctctataaaaaatatgaaaattagccagatgtggtagcatgtgcctgtggtcccagctacccaggagactgaggtgggaggatcccttgggcccgggaggcggaggttgcagtgagccaagatcacatcactgcattgcagcctgggtgacagagtgagatcccatctcaaaaacaaagagaaagaaagaagaagacagagaaagagaagagaaaagaaaaagaagagaggagaaaagaaagaagagaaaagagaggaaagaagagataagagaggagagaaaagaggggaggggagggaaggggagaggggaggagagaaggggaaaggagcaatgggatcctgatatctggtatgggaaaacttaagtggatacatctgagaactttgaacctccagtttccactaaatgctctgatctaaaagaagaaatgctctttccttgctaagagaagggcagctgccccttgcctggaaactaggcaaagagcctccaacaaggccttacagcaggatgaagtgtgtcgtcattgctgccccacattgacaccaggctatggtcattcctcatcatggcctaaggtcacaagcacaatctgctctgggagaataatatttttgccaaaaatgtcacaaagtatgtactggcagaatctgagagaggaggtggaggagtggacataagggtgttggaccagggggagactaaaggctgtatacacgagaatacagtgacctgggagcactctcaggatttaatggcttggcaaagacacctggggctccaacacactgctgagtggctccttgaaatgtggacagaacagttgcttcagtgaattaggaggagattatagaactgcattcgcaaagcatcaaagaagcaggaaagtacagggaggtaggaatgttggaatggttcattatatgccagcagattcggaatccaccacttgactgtgtgcccttggagggctcacaggaactcccctctctaggctaacaaggaaggcactagtgagaagggcacctgaatctttaagagactcagtggcactatccttggtaggccaggatcgacaagaggagatgctgccatgagaccaggcttcgtggtgtcagtgggaacggtggaaggtgagaacagcggatgccaggtggtggcccttcaccatcatccacaaggtggatgtaattaacttaattggtaggaaggctagagtgacagccaggatgccttgacctccagggagctgttgtgttagctacaaactgatggcattccaggggagagttacataggcagttgattagggtattttgggtttttttgagacaggatcttactctgtagcccagtctggagtgcagtggcacaatcatagctctctgcagcctcaacctcctgggctcaagcgatcctcccacctcagcctcccaggtagctgggattacaggcatgcaccaccatgcctggctatatttttttctaatttttagtgaagatgaggtcttgctatgttgcctagactggtctcaaactcctgagctcaagcaatcctcctgccttggactcccaaattgttgggattacaggtgtgagccctaggatatttcctgatttgtgtattcaggaaacaacaacaacaagatctggcacatggaaggctgcaacaaaaaattacaatttcctagccagttttcagactgagacaattgagacctatagctcatggattgtaggggaggctgggtattcttggaaaaagatcctgcaacattaccacatggtattcattaattattctccaaagggatctggggtcattgatgaaagtaactgtagctgatgaaaagggaatacccagactgtttgagggccatttatataggattagagctgaccctgacaccataagatccacaatgccaccatgtcccctccccaacaagactgaggacatgtgaaatctaggtaataaatggatccctggatgaagaggccacagccccatccggttgtcatttctctgtccctaaatatgcaattgatatgagtatgcttagaagctaacagagctctcactttactccctgacctgtgggtatgagccactatagtaggaagagcccaggggaagtctctgaaactacctcttcccacttccgggagcaatgcagtattccaggtggaatcacagagatttatcacctccctcaactgtgaccgccaccttataatgatggtattcttacatttccccacctgtcccttgtgccattctcatcatcattttacttccacacgttataaaccccacaatgttattacttttgcctcagtcaattatttctagacatcaaaaaatgagaaaataggatcttttctatttatccatgtatttattatgtcagtggtcttcattcctttgtgtagaaccaaatttctatccagtgtcatttttcttctgaccaaagaactgcttttaacacttcacagagtgcaggcctgctggtgattatcctggcttttgtctgtgtgaaaaagtctttattttgtcttcattaaattttttaaaaattttttattctgttttttgttttttgttttttgtagagatgaggcctcactgtgttgcccaggctggtctcaaactcctggcctcaggcaatcctcctgcctctgcctctcaaagtgctgggatgattacaggcatgaactaccacacctggcctcactgactttttaaaactgcttttaatcccttatctgcagagttaactttttcatgtccagtaattcttttttgttttattttgagacaaggtctcactgtgttgccaaggctgcagtccagtggcacaatcacagctcactgcaacctcgacctcctgtgttcaggtgatcctcctgcctcagcctcgtgagtagctgggactacaggttcatgccaccatgcctggctaatttttaaattatttatagagatatctcttcttatgttgcccaggctggtcttaaactcctgggctcaagcaatccttgtgtctaagcctcccaaagcactgggattacaggtgtgagccaccacacccagcctgtgttttttttttttttaatacatcttccatttctctcttctcatcatgttcagatttttctagccttcttgaacatatggagcatatttataatatgttttttaatgtctttatctgctaattacatcatctttgtcatttctgggcctatttccattgatttatttctctcctggttataggccctattttgcctgtgtttttcttttgttttgtttgtttgtttgtttgtttgtttttggagacagggtcttactctgtcacccaggctggagttcagtgatgtgatctcgcctcactgcaatctccatctcccaggttcaagtgattctcgtgtctcagcctcccaagtagctgggactacagttgcataccaccacgcctggctaatttttgtatttttagtggagacagcatttagccatgttggccaggctggccttgaactcctggccttaggcaatctgcacgccttggcctcccaaagtgttgggattacaggcatgagccactgtgcctggccattgcctggtaattttttattgactgtgtttttgtgttgtgactgctggattttgttttgctttaaatagtgtgggactgtgttccagcactagttaagttatttgaaataagttggatctacaaaggtttgctttcaatctttgttaggacagtttcagagaagtctttactccagtgctcatttagccccactattaaggcaatagttttttaaagcttctcttccatttcctaagtattatgaggtattttcattctgactagtgagaatatgaattctctctagcctgttgtgagctctggggattcttctgtctgctttctggcagttctttccctgggtactttcttctcacatatgtccctatcagccctttgccaaaggcttgagggcatcttccatagctctccagagttcacgcgctctcttctcccacctcctccctggtactctacctcacaaattctaccggccttgaagatcttcccaagctctgatctctgtctcctcaatccaccaagaccaccggactttggattcccctccctgtgttggagcctgtaattgcttccggcagtaaaccgaggacactctagggttcaccttcttttagggatcatagttctgctcgacctgttctccgatgtctgaaaactattgttttatattttgttccatttttctagttattaaaggtgggaggcaaatctggtccctgttatcagtcatggccacatgtagaggttgcaggatgttgtttacatctgtatctttttttttttttttgagacaggatctcactctgtcaccccaagtggcaccatctcggctcactgccacctccactttgtggcctcaaatgatcctcccacctcagcttcccaaagtgctgggattacaggtgtgagccactgtgcctggcctgaaactgtatctttcttattaccagagaagttaaacattttttcctgtgtgtcagcagcatttgtgtttctttttctttgaattttcatttttccagtttgaactttccatttttcttagaatttttggtctttgtcttctctacttttagaatagaatgaatatgatattaatcatacttcgaattgtggccatgatggagtacctgtattgatgatggtctcccagcataaacaactacaaagctggacaaagtacatgaagaaattgtcttcagccattgggcaataggcagttccaggtacaatctgagagaagggaatcacatgaagttactgctacatttttctggtggggaaagtttcaaaaccctcaatgacagcacgaggaagcagagtccaggcaaaggatcagtcttgtttggtggaggaaacggagactgctgctcagggctgctaaaatgtgtgtggcagggtatcagaaaggatggagttgcagagaaggagccccagaaatcttatagaggttgctgcaggtccttggccaaatcccaaactatgaatgtgtggattgagactctgcaaggcctagcacagaacagccgatggggagctgagagctaaacagcgatttcagtggtcacagagtgctggaaacacatctgaattctggctcagccagcatctccactcttggaatctcaggacttgatgaatatcccagacattcacaggagggcctagaaggccatgccttgggattaaggaagattctctaggaataaggtcaaaactaaaaaccagctcacgctaacaaaacctaaaatgtagccttgacacacgtgatcaagttaacccatcagtaatttaattccctgccaaaataaaactcaacactggagtaggataacataacccacatctctacaatgaaggttcacaatgtccaacagctcaagaaatacttagaagacatgagaaaaagtgagaaaatatatcctacaattaagagaaaaccagtcaatacgaactgacccactgtgcatggtggctcacgcctgtaatcccagcaatttgggaggccaaggcaggtagatcacttgagctcaagactttgagatcagcctgggctacatggcaaaaccccatctctactaaaaattcaaaactgagttgggtgtgggggtgtgcaggggcccataacccccaggctgtggactgtacccgtcggtgacctggtaggaaccaggctgcgcagcaggaagtgagtggtggacagcgagcattactgcctgagctccgccccccgtcagatcagcaggcattagattctcatagaagcgtgaatcctaatgtgaactgcacatgcaagggatctaggtttcacactctttatgagactctaatgcctgatgatctgaagtggaacagtttcataccaaaaccaccacccctgaccctgtctgtggtaaaattgtcttccacaaaaccagtcaggactgctggtggcacatgcctgtggtcccagctacttggaaggctgaggtgaaaggatggcttgagcctgggaggtggaggttgcagtgagttgagatcatgccgctgcactccagcctggacaacagagtgaaatcttatctcaaagaaacaaacaaacaaaagggccgggcatggtggctcccatctgtaatcccagcactttgggaggctgaggcaggcagatcacctgaggtcagaaattcaagaccagccaggtgaggtggaggttgcagtgagccgagatggcagcattttactccagcctgggctacaagagtgaaactccatctcaaaaaaaaaaaaaaaaaaaaaaaaaaaaaaaaagggggcccataaatggctcacacattggaattagcaggcaagagctttaaagtaactgcatacatacatcaaagattttagagaaatatcaacacctgtgaagatggtgaaaaaagaatttagagaaataatttttagtataagtatgtcctaaatatgcatggtacatacttactaaaatatagtttattttttaatcagaaatctaaatttaactgggcatcctatattttatctggcatctctaccccaaagccaagaaagagagaatccagagtcctatcttttagcaggtgacctagcctaggacagggcctggccaggggcaattgtgcattggatggattagagatgccagtcattcaaaggtttgccagacctgcatacaatcaacattatttttatttaatatttttgtctaaagcaactttaaaaatgttaaccctttatttggaaatatagattcagaggaaatttcaaagatggtacagagaggtttcatgtactttttactcagtttcctccaaaggttctattttgtataaatgtaggacaatatctaacaatgtcacatgactatgtctatgccattttatcacatatgtagactcctttaaccaccgctacgatcaagatagagaactgttccgacaccacgaaaattccactcctgctattactctgcactcattcctggctcttcccctccactattcctactcctggcaaccactaatctgctttctgtctttataatcttctcacttcaagaacattataaaatgcaaaaattagccaggcgtgatggcgttagcttgtagttccagctacatggaggctgaggcaggagaatcacttgaacctgggaggtggaggctacagtgatcctgccattgcaatccagcctgagagacagggtgagactctcaatgaatgaatgaatgaatgaaagaagatctggcatggtggctcacacctataatcccagtgctttgggaggccgaggcaggtggaaccgctgaggcctggagtttgagtccagcctggccaacatgacaaaacgctgtctctactaaaaatacaaaaattagccagcatgatggtgcgcgcctgtactcccagctacttgggaggctgaggcatgagaatcacttgaacccaggaggcggaggctgcagtgagccgagattgtgccactgcactccagtctgggccacagagtgagactttgtctaaaaaaaacaaacaaaaaaaacaaaaccaaacaaagaaaaaaagaacattatataaatggaatcacacagtatgtggccttttgagactggctttttattttttgtactcagcaaatgccctttgagatccgtccaagttgtgcatgttcctttttattgtttttttttctgtttgagatggagtctcgctctgtcacccaggctggaatgcagtggcatgatctcagctcactgcaaccctccacctcctgggttcaggcaattctcctgcctcagcctcctgagtagctggaattataggcacccaccatcatgtctggccttttttttttttttttagatgaagttttgctcttattgcccagtacataggcatgatctcagctcactgcaacctctgcctcccgagtttaagcaattttactgccccagcctcctgagcagctgggattacgggtgccccccaccatgtccagctattttttttgtatttttagtagagatgggattacaccatgttggccaggctggtctcaaactcctgacctcaggcaatccacctgccttggcctcccaaagtgctgtgtttataggcatgagccatcgtgtctggccccctttttattgttgaatagtatttcatagaatggatgtatcagtttgcttaaccattcacctatgggggagtatttggttgtttccaatttggggctatcacaaataaacctgccataaacaatcatgtatgagtttttgtgcagacatcagtttatttattttctggtacaaatgcccagaagcaattgctaggtcatatattgaggtgtatgtttaattaaaaaagctgccaaactattttctagagagtctgtaccattttatattcccatcagtgatgtatgagttagttttgtctgcatcctcgccaatatttgatattatcactatgtttgatttgagctgttctaatagatatgcagtgatatcttactgtggttttaattgcatttccccagtggttagtgttgaagatctattcatgtgctttaagtcaactcatttttaaaacctaaataaatgtatttaaaaaggaaactttcgctttgggaggccaaagcgggtgaattgcttgagcccaggagttcaagaccagcctgagcaacatggcgaaactctgtctctacaaaaattacaaaaatatccaggcatggtgacgtgagcctatagtttcagctacttgggaagtgaggcaggaggattgcttgagcctgggaggttgaggctgccgtgagctgtgatcgcaccattatactccagcctgggagacagagcaaaaccctgccttaaataaataaatgaataaaaggaaatttgtgattagtggttctcaaagtgtggtccctgagccagcagcatcagcatccccatcagctgagaacttgttagaaatgcagattctcaggcgccaccccagacctcctgaatcagaacctctgaggcgtgggttcagcgacctgtggtttaacaagccctcccggtgagaatcggtctcattcactacagatagaaggaaatggtaaaaatcaattcatccccgtatcgcctaaaatcctcctgtgggccccaggttggcacagcacacttttgggcaggagccccactcacagaggccgtgacaagaatgctcctgcccctggggttgtgcagtgacagctcacacagctccacgtggcggttctgagtttgggaagcgctgatgtagtcctactacagcccttcctgcccttcactggactgagaaaatccaggctctgaggagggagagacttgcccaaggtcacccagcaacatggtcagtctcctttcccagggccctcacaatgcgtggcctgtttaaagcctgcctctattcactgctgagtgaaaaatccagctccaaaacagaatatggggaaggatactatcttgtgcagcttatgtttatagctgcagatacgtgggaaaaaaagtcagaaaatactgttgaagcagttacttagggagaaaaggtgtttgctggtcttttgtgtttttaacttttctatatttcataatttttatcacaataatgtttagttacataatcaaaatgtattaaatgttaaaaattgacatgaagcctgatccagccacggcctattgttggcagagtcaggaagccttccagatagagcagccccgcacctgccccaggtcacaccctgggcctgggcacatgctaggtcctctgtctggacaccctcaccctgtggtggcctccacgtccgtacccaccagcacctcctgtgggcgaggccctacattacatccagccctgggcacccactagcccagagggcacctcatggtctgagagcccgcctgtctgtctctaaagagaggaaaactccttgggacatgtgttccacttgacccatcacccctggcctggtacagaaaggtagacagtgggtatttggtgaataaatgaatggatgattagaatgaattcccaaaatggcaatttcctgaggcccttctccagctggcccaggtggaaccagttccacttttcacaggaaagccaggtgggaggagtggggcaggtgtgtgtgaggggccagattcttgagggctgcatggacatggggctttggcgggtctgggggcggcagtgcttctgtgggagcctcagggagggctcatccttggaatccaccagggtatcctggtacccccagctgctgcgtggcgtgagaagtcctggctggtggggacacacaggtacttgtttggattggccacctggtccagcccaaggagctgtgcctccagccccttggggaaaaactcacttctgatgtgtgacaacagctgcaggcaaggggagggagaggtgtgctgggcctcggccttagaagccagaagccctaccttggtctatatgggaaaggcatgcggcctcagctagatctagggtcctgggttatggtcagaaccctcccttatggactcagtgacttgggctgaccccgcccctccctgagcctcatcagtgaaaccaggatggggccagggctctcgacacctcccagctcagacctctgactttctcccaggagggcaggagatcagacagaggtgacccgggctctcctgtttacctcaacctccttgtgaagcctccctctttctgcctgtgaggtgggtggggccggaaggaggggcattcacctgtaggcctctgacttctctgcccaggtgtacctggagagcctggtctatacccggtgctctgctacaccccatggcctggccatgacctccctgcctccagagcagccctggcccagggaagaagctgtctctgcatcgaatgataggtggaaaatggaagtggggatgatagctctgaaaaggagtcaaggaggaggtgccttcccaaggatgctgagggtttttccagaatggaacttgactggtgcgggcaaacatcaggaggtgggaagggtggctccctctgtgggagccagggtgacttgcctggatcgaacagtggtaggcagtgggtagggcaggcagagctggggtgcccagagcctggggtccctgtccttgcagaggactggattgcaaaacaagtgtcccctgccttctggctgggggacatcctctacttccaagcccagacatacacctgctgccacaagcccctgaggttcttcagaggaccaatgggcagccacacccatgctgggccagcctgctgggcccacctgcaccatggtcagagcccatgactgaggggactctctggggacaatgggggcagtctcatgctgccctcttacaggtggatcagtccctgggatctggtgttgggccggggtaggctgagtatgttctctgatggggtgccttgtggacagcaggtagagcaacttcttcttggctttcttggacctcaggacatagctgaacactgcgctttaccctggatgccttcagattctcaggggaccctgggaaggaagaggggctgcccctgcaaagggccagggccctggcccatggttgcttcccccagcaggtacctcctctccagattgacatcacctgattcctgaaggcctgagctacagaccagagccccaacaccctcaccaaggcctgttcttaatcagagcagctagtatatgattccggagctgaagcgggcagagagagaatgcggggctctgtaagacttcttggctccctgctgcggtgggccctgtagaaggccccccagaaatctgcagctgctgtaagtcactgggaggaagctgcagcagacatgtgtttcccagcctggtagatggagaagggtttccgggtctccgagtgggaggcccaaacgtggccttggttgtagcagtgcaggaattctagccagctctggggcccagggcaagtcatttaacctctcagaaccccactcctggtcaccatgtggctcttgtgtggttgtaaagaacacccctggccacttatgtcccatcagtggaagcctagcatgggtggagacccccgagactgaactcagtggcaggatccagcctttccagctctcctacatagagcccagagccagcagggtgggtttcctgaagaagcaggcactcctgtgggctggagagcatgattaaaggtccctttgggaaggtggaagaggctgcggtcagtggaggccataatgaggcagagcttgggcagaaggggcatgattgggggatctgagacccaatagagactggactgaggacactgtgccactcaggtggtggaaactgagctagggctgggccccctggtcccgagtgaggcctcaccagtcttggaagctgtgccaaaggtggcttcatgtaagggtgcatctgaacactttttttttttttaagagatggggtcttgctctgtcatccaggctggaatgcagtggcatgatcatagctcactgcagcctcaaactcctgggctcaagcgatcctcccacctcagcctcccaaagtactggaattacaggcctgagctacagagcctcgttttaaatcttaataaatatctccccctggtctgcttccctggctgacacacatgctggcaacttgcccctagacagacatgtttctggacttggttccatttgttctgatgggctcctctctctcaatgaccgcacgttatattatgtggccattcttacacgtttctgtatagacctgagggttagtgtattaatgtcaaagttctactggtttttcgaggctgggtggaatgtttgggttaatttaggagtgggcatcttgacaatataggcttttcctccgggaatggtgattctgggacgcaggttttgcacattctggtttattgcttggctcgctgccacagagggatggcactgctccacatgccatgcccaagagatgtcccaccttatctttctaaatcaagctgaatgttctcagctgacaggatatcctatcagtgctgcggggactcacaccttccaaactgagatgaagtgaggtggagactatggagcagatccgtgctgactgcattcgcccttcctgacccacactgctgctggccggggctatgtctgagccatcagagggcattgatttggggacggggcggggggcggtcctggagagatgcccctcacctccctcagctcctcctgtccacctaacacttggccaccaaggtccctgacttccaggccccagtcaccactaatggggtgctgcatgggaacaaagtgtaggcccagaacctggagctcaggtcactcctccttccattcgaagcctctgcccctcccaggtgattccaccctcattcctccatgggccaaatatcctaaacaaaggcctggacaggggtctttatccgagtactcagaaaacacacacggaaatgctttgcatgccccctgtggcctgccaggggtaagagcctgcccgtcaaaatgcacagtcctggttcttgcagggaggtgaggagcggaggaagaaaagatccatctcattctttcagcaggatcctaaacttgggaaagccagatgcagtacatttcttaatcctgatacttttataactggttatagcggggtcacatgcgcaactgttttccaacatctttcaacgggccacataacatcctgtaacttctttttttaatttttattttgtaaggccaggggcagtggctcacgcctgtaatctcaacgctttcggaggctgaggcaggaagactgattgaggccaggagtttgagaacagcctgggcaacatagcaagaccccatatgcaacagagaaaaaaaattttttttttttgagtacagtggcatgatcacagctcaccatagcctccaactcctgggctcaagcgatactcccacctcagcagctgggactatcagagcgcagcaccacatctggctgatgttttaatttttagtagagatgcggtctcactatgttgcccaggctggtcttgaactcctggcctcaagagatcctcccaatgtgacctcacaatgcactggggttacaggcatgagccaccatgcagcccctgcaaaatctaactgtccttcaggtgctccttttggacctcctagctagactgccattggcaaatgccagttgattatccacccacatttatgttaatggatttcccatgttttatttgtctagaccaggctttctccacagcagcactgttgatgtttagggctggacagttctctgttctggagctgtttgcgcctcgcaggatgtttagcagcatccccagcctccgcctgccacatgccagcagcactcctcagtgtgacagccaaagtgatttcagatactgtcaaatatccccagggcggcaaaatcacctccagttgagaactgctgacctaaaaccctctggaacaatgttagatcatggtaatgatagcgcatactgctcctgaccttaatgggaatacctctagcatcaaagtatagtagtacctgtatactactgtctgggctgttattagtacactgtattagtccattctcatgctgctatgaagaaatacccaagactgggtaatttataaataaaagaggtttaagttgactcacagttctgcatggccggggaggcctcaggaaacttacaattatggcagaagacacctcttcacagggcagcaggagagagaaggagagccgagcaaaggggaaagcctgtaataaaatcatcagatctggtgagaactcacttactatcatgagaacagcatgggagaaaccacccccatgattcaattatctccacctggtcccacccttgacatgtggggattattgcaattcaaggtgagatttggatggggacacagaaccaagccatatcatatcctttatattagcatactgtatcaaagtataattttctttcttttttttctttgggacagagtctcactctggctctggctggagtgcagtggcacaatatcagctcatggcaaccttggctcactgcagcctcagcctcctgggttcaagcaattcttgtgcctcagcctcccgagcagctggaactacaggtgtgtgccaccaatgcccagctaattttgattttgtttttagtacacatggggttcgacatgttggctaggctggtgtcaaactcctggcctcgagtgatccagccacttcggcctccagaagtcctgggattataggcgtcagccactgcacccagcctgaagtataattttcacaatatgaaaagcttgactttcatacaaataatgaaggaatacgtataagatattttctttaatttacaagggagtcagcaacacggtgaagctagttcaaggagcgttttgagagacagtgtctgtagtgctccaggaagggcattccgaaatgcattctgagatagagacaaaacttgttaatatcctaaagggaggccgggcgtggtggctcaggcctgtaatcccagcactttgggaggctgaggtgggtggatcacctgaggtcaggagttcaagaccagcctggccaacatggtgaaaccctgtctctactaaaaatacaaaaattagccaggctcaatggtgggtgcttgtagtcccagctactcagaaggctgaggcaggagaattgcttgaactgggaggtgaaggctgtagtgagccaagatcatgccactgcactccagcctggacaacagagcaagattctgactcaaaaaaaaaaatcctattgggaaataaaactgtcatctttgggagttatcttttctactgtactgaaatctgtaagttaacatatatacatattctcacatatattcataacatattctctagtatatttccctacattagtggttttcaaaccatggtctcaaattggaagcaccagcgtcacctgggaacacagacatgcaatgcttaggccccacctcagtcctattgagttagaaactctggtgtggggcccagcagcccatttcacaagccttgcaagtgattaggatgcactctaatgtttgagaaacactgctctaaatagtcaatctttaatagtaaaacaagtatctatgaaacaatgctcagtatgacattaaaagggcgcaccacccaccttttaactttatttctgaatttaaatattttgtctgtctaatgttaaatttgctgttttgtttttcaaatactcttaagataagacagttttcatctgttcctaattttctttttaaataaaaaatggtcccaaaactatccatttttctcttctttaacctactgacagcatgaaataaaagttgaaccattcctacatctttttttttttttctcaccttgttgctcaagttgactgaaatgcagtggtgcaatctcggctcactgcaacccccacctcccgggttcaagcgattcttgtgactcagtctcctgaggctgggattacaggcacccagcaccatgcccagctaatttgtatttatttatttatttacagtagagacgggttttgccatgttggccacactggtctccaactcctgacctcaggtgatctgcctgcctcggcctcccaaagtgctaggattacaggcatgagccaccgcacccagctttttttcttttcctttttttgttttgagatggtctcattctgttgctcaggctggatggagtacagtggcgccatcatggctcactgcagcctccacctcccatgctcaagagatcctcccatctcagcctcttaggtagatgggatgacacgtgtgcaccagcacaagcagctaattttttgtagagactggggtctccctatgttgcccaagctggtctagaactcctgggctcaagcgatccactggccttggcctcccaaagtgctatgattacaggtcttatgttcttaaaatttttctttgacatggtataggatagtctagtaacttaacacactgttgctttcaagaggatagtgcttatgatttgtaaaataactcttcagaaatgagttcaattttaccatgaattgggacactttctatttctattctatagagcagtttacttgtcatgaggtctgtcttttgaaaacttgaaagcctgcaacaataaaaccagctgcacctggtgcatgggataggcatggaattgaggagagagctcaaactatggtcagccttctgtatcctcgggttctgggtccttggatttaaccaactgtgcatcaaaaatatttggaaaaagtaaaacaataaaaaaacacaaaaatttaaaaatactttatatcagctatttacaaagcatttatgttgtattaggtattatagcaatctagagatgatttaaagtatacggaaggatgtgcataggttatatgcaaatactatgccacattatatcaggaacttgagcatctgtgaattttggtatctctggggtcctggaaccagtatcttgaggttactaagcgacgactgtattcaatttcttctttggttattagtttattctttaatgtatttttgttgttgttttgtctttttgtttttgcctcttcaagtcaacgtcggaaacttagttgttctagactacccattagctcaaagctaccagtaatcagactaccactgcaatctaagcaaccgattttttttttacccatcagactggcaaaaattaagataagatctattgatgttgaagctgtggggagttttcctgagcatgttaattatgacagccctttttactaggcacctagacgattcatcaaaatgaaataaaatacccatgcacttgaagaagttacctggttatttccttatctgggtgctggttatgtgaggtctacagttgatgaaaacttattaagctttatatttctaataggtacaattttctgtatgtgtaatatatttgaaaagtttttaaaatgttttttgccacagcccgcagctgtgtataatgctattcgcttaacagtggaaaacatggcaatgacctgaatctccctggctcccgggatcctacccccttaagttaacgaaaataaaagtaaaagaaataacttccactgtctttcgtaatgccttaaatccgtcctcagttaaaccggcggttggcgctggttttttccagggcaggattctgggagacggaggagcagacgccagcatttcgcccccggcacctccagcgggctgcggtccgctcccggcctcactcgagcaggccccgccccgccagaggccgttagtccaagtcacgtgatcgtcgactcagctgacctggcgggaccggaaaaagaaattcccgggcgatgatgaggcaccaggggtgaagcggacatgggctgctggagcgggaatgagggggcgccagtggctccggaaacgggttgaggttgtctgcactggccgctccgcaaacacagtgtgtgcgggcgtcagggcagcaggtctggtagagaaaagtccaccgccatccctctcccgagtggggcgggtaagacagagcaggccggccggcttagagttccctgcttccctggcggaaggaagggcccctgactcctggggcaggaactagggcttgtctggagctgggagtcctttcaggtcttctctagctccaaaaggacctcccaaggacacccccttccccagccctgctgtgggacttggacaggaaagtgctagaatcaggctcactcttgcacactgttaggaagccactccgctcttttcagatccagaaagtagtagttttggggctgatacttatccatccattcatccaatccatccatccataggttcaaagtgcctagtctataccatgaattgtactaggcactgggaggacttgagctgccgcgggaaggggaaatcagaggcttgaattggcagtcatagttaaggctccaggggcagagacctaactgcgccttgtgtgtagtgctaagggggcttcctgaggatgccttcaaccttaaaggcgatggcaggagttggctggctgaagtacagtttgtgtaccaggggttgggaggcaacggtgggaggcgtgtgtcttcagacagggaacagcatgtgcagagacttcaggtgagagagagcatggctccccaggaatgaatgcatttcccgtagctgggagagtatcatctggaggttagggaaagatgagtctggacaagtaaaggccaaatcttcctgactgttggatcaccacaatcaagataacgaatatatccaccggcccccaaaatttccttgtgttaggggctattttaggaagtatgatcaagaagggctggcctgccagggtggagtggctcacgcctgtaatcccagcactttgagaggccaaagtgtgcagatgacctgaggtcaggagttcgagattagcatggccaacacggtgaaaccctgtctttaccaaaaatacaaaaaagttgggtgtggtgacgcatgcctgtagtcccagctacttgggaggctgaggcaggagaattgcttgaacccgggaggtggaggttgcagtgagccgagattgtgccattgcactccagcctgggcaacagagcgagactccgtctttaaaaaaaaaaaaaaaaagaagggctggtctgatgaggtgtcacttgagcagagagtggaatgaaataaaggatagcaagccacatagagagtgcagcggaagcaaggctggtgtccctgagctgcagcagggaagctggagtggctggagttgtgtgggtatggggaagaagggagagagttcactcgtctctgtgaggcccaggactttgttttatcccatgctgtacccccagcacttagagtgggagctagcacagagaaggtgctcaattgatgtttgctgagcagatgaatgcctggagtagacctcagagcagggtttggtggcagggtgggtcaggtagagtttactcaacagcctggtgataggggagaacaagtggccagagggtatccatctatgtcggggaccaggggtccctgctgggcagcagtgtgggagacacagggatcctggccacacctcagtcttctttccagcctgattacctgcctccctcccttgcagaggtttcggttctgtggtgatctggactgtcctgaccgggtcctggcagagatcagcacgctggccaagatggttgagtgcacagggtctacactgggtggaggaggggtgttgggctggggattgtggctgtagaggatggtgaggtttctctggggctagggcctcagtgctctcagcctgtgctaccatgctttgtgaccttgatcagtggctggcctgctttgagccagtccccaggaagaaggggtgaggtttgccagcctggctgatgtaaggacttcctttccagtcctctgtgaagttgcagctgctctgcagccaggtactaaaggagctgctgggacagggaattgatgtgagtacaagatccagcaccccattgtcccatgaccttatgaccaccactgccctgaaactctgcactaggcccggggagacgggtgagccagcctctcaacctctctgggcacctcccttccttctttccagcctgtctgttccttattgcaggatccaggctgggggtgaggggctggtgagcagggacctggcaccccctgaaggtctcctttccccatagtataagaagatcctgaaactcacagctgatgccaagtttggtgagcaccccgctgagttcacaggccccaggcaaccctgggacctcggcctggtgcctggtacagagcccgccccccacccccccgccaacacacacatcccagcagtatccttaacctgccttccctagtggaggagcatgagggaaagaaagacattgacagtcccaccttcctgtcctctgccagctcctggtggagcagtagcagtgcctatggctccaggaggcctgggggctttgagctgaagttaatagggcaacagggaggtggctgggcccacagtgacaccccctgtcccatgcatgggtccctgagagtcaggcgatgtgaaggccacagtggcagtgctgagtttcatcctctccggtgcggccaagcacagtgtcgatggcaaatccttggccagtgaactgcagcagctggggctgcccaaaggtacgggttgtgggtgggcagctgggcagcctgtgggccaagggctgctagagagtgggccaggccctgtgaccctgaggtgtaccctgccctgtctgggccaggagcccaagcccagcccccacctgctacctccagagcttctccattctacccccagagcacgcggccagcccgtgctgctgttatgaggagaagcaaagccccttgcagaagcacttgcgggtctgcagcctacgcagtaagtatgaggccagccagggtccgggctcatcctagaaggtgcacgcagcacacaaagtgcgtggagagtccagggagacaatttaaccgcagtcacataccgagcagccgcagagccgggacgtggccctcggtctcctgaccccgcgcgctctgtgatgtgtacgtacaggatcagaccttgccctttcctcctggctgacccttccttagtcccccgtgccccatgtgtgagcacccagctcactctcattcctccctctccaaagcgtggtccctggcagcacgagtggcagaagggacagcagagactgtggacccctcagctgcacctaagacctctgtgtggtctagccgtgtgtgctgggggaggcttttggccaccatttccccctctgtaaatgagaccgatacctgtggcatggaggacaggaggctggtgtgagtgccaagcacttggagcagggccctgagtgagcatggacatgggaacaggggtgtttctcgactttgtgcaccttggggatgggagtggggctccctgcatgggttgacaaggcattgctttcccccaccccacctctgtcccagccctgcaagtccagtccttgggggtctaggaaggaagaagcccctggctgtttggcctcaggctggtgcctggccctctctggctctgagttcctgggaaagtcagcacccaaggcatgccctcaagtttagcaccttgacaagaagggcggggacactgggatcaggcccaactctttggccccaaatcccacggccccagctggaggatgaggagacgctgggcttggatggggaaatcaggggtgtaaaggggcctgctcacccctcagcttggctcaaaggctcaaggcgtcaaaggctcagcctgccactcaggaaggagccctggccaagccagacactcaccaggacaagggcaactgtgatgagcaggaggcccaggatgaggagagccatggcatagctggagataaaggcatccagcaggctggaggctttggggctaggactgcctagagcagagcaagaaggctatggccaggcggggctctgcctctcagacttctgagaagacagaatctgggcccagaagttgctgcgggaccagagagctggggctaggagcaccttagagggctccatgaggaggggaggcaggcttcagatcagggcatgtggaggcagcgagcccaagggaggaggcagagggacagagggaggcagcctgcagagggaaggaggtactgaccgaggtctaggatgaccatgtctaccaagacgcccgctgcctcccacagggtgtgcaggccctggcgtgcacagtgccacatgacggcctgggctggcgccaccctgaagaaggtggcacccactctggcggtcagtgggtccagcctgctgagaggattatcacagacttcaggggtctgtgcagccttgggggactaggggaggtcatctcttccagcctcctgtcctcaaccccagaaccccggtatgagccctgggtcacccagggccaccccggacccactggaattcctccaccaccgcttggtcaaagttctgcagagatctgaggacaagggtcagctggggggtcagaagaggatgaagagggtcacagctctaccaaacaaagcttcattccttgtggcccctggcccacccctctgctgccaacctcaggctggcccagccctgcagagtaggtgcccaaaggcatcgtagcagttcctgtcatgctggtctccccccggggccccctctggagcctggtaccacagatctcagggtagggggtacagctcagtctcccttccctctcatccccctcataggggcttagtccaccaaggcccctgactgctaggggacccacacccacggcctccttctttctgactgctggcccttccccagcctggatacttgagccctgggcagaggggtaacaatcccaggactgtcttcataagcagagaggccacttggcaccaggctcttactccttgggctgagctcagcagcaggtgtgtcaccaaggtcccctgggcagaaggggctcagccctgagggcccatcactcgccatgcctgcacgttcctgctaggcatccaccctggggacccagctttcccccttcccccagctgctggcaggcctgtcttgattcatccagggtccttcaggccatgccgggaagcagccagcagctgggaggagcacttggggtttctgcatctttttttatggagctgacttgggtgggaggggctacagactcaagggagactgcaggccaccccttccccactccctggctgggtaggcttccagctcaggagtctgattggaaggatgggaccgtcctgtcacagaggcaggtctgagtagtccaggcccagttttaccctccagcagggcccctttcattcatttgtccagctggctttgcccaaagcacaagtaatgtctatgtgtactgtgtcccctgtccccaaggggagtatggctccagtcctggcctggaactcagagaccttagaattagaggccacatctggcagggtggaccagcatggtctgcccacggccagggcaggtaccatgttggcagccccagacctgacaccacggctcccgtctcccctctccacttccatcctgcacatcacctacactacgcgctgtccctgatgaatccaagctgtcagcttctgtcagcttggctgggaagtcatgctgaccgtaaggggaatggtgcagcctgagttgggggctgagtgggaatgggcctggtgtggggtgggggaggtgggggtgaggcgggtgtctggcgcctctctgcttatcttcctttctcctttgtccacaaaggaggcatcttttccatgtccctctgccaccctggggacataaaatactgccccacttctgtcttcccttggacatagcccacctatcttcctgtgggactcagggctttgttttgtcctgtggcccacatgagaagcaattatccctgctctgctcagctgagagaggacaaactgaggcagagcaggggaacaactctgtcatagtctggctgttaatggcagagtaaagaccagcccttccctgagtgtcaggtccagtagacattatattagtccgctttgcattgctctagaggaatacttgagactggcttatttatttatttttgagatgaagtctagctctgtcgcccaggctagagtacagtggcacaatctcagggcactgcaacctctgcctcctgggttcaggctactctcctgcctcagcctcctgagtagctggaattacagccatgcaccaccatgcctggctaattttttgtatctttagtagagacagggttttgaaatggagtttcgctgttgtggcccaggctagagtgcaatgttgtgatctcaactcattgcaacctctgcctcccagttcaagcaattttcatgcctcagcctcccaagtagcttggattacaggcacgcaccaccatgcccgcctaattttgtatttttagtagacagggtttcaccaggttggtcaggctggccttgaactcctgacctcaagtgattcacccgcctcagcctcccaaaatattgggattacaggcatgagccaccactcctggcactgagactggttatttataaaagaggtttatttgcctcacagttctgtaggctgtacaagcatctgctaggcttctggtgaagcctcaggaagcttttacttctagtgcgaggcaaagagggagcagacatgtcgcatggtgagagaataagcaagagagaggaggcatcaagctctcctgtgaactaatagaaaactcactcattgaatcacttgaacctgggaagtggaggttgcagtgagccaagatcatgccactgcactccagcctgggctatgagcgagactctgcctcaaaaaataaaaaaataaaaaataagaaaactcactcattaccatggggagggcactaagccattcatgagggatcccccaccatgacccaaacacctcacactataggccccatctccagcactggggatcacatttcaacacgagatgtggatgggacaagtatccaaactatgtcagaggcctccccctccctctcatcagaatcttctgtcctcagttcaggtgcatgctggcctccatgcctggcttcctagaaagtcatcttggcgccaaggggttgggcagggccactaggctgagggttggagccctatctctcctagtcccagcctgggtctccatcactgggtaacccgtactgctcgctgcattctctccacacctgctccctacagcccaggggtcagtctgggtgcaggcctgggtagaggtccaggagcagattctgccccccagctcatacttcctgtgcaccatggcagaaaatgcaccagcatggccaggagcactggcttgtccctgtagtctcagtgttttgggaggctgaggtggaaagatcgcttcagaccagcctgggcaacatagtcagaccctgtctcgaaaaaaataaaattaggcatggtggcatgcacctgtagtcccagctactcaggaggctgaggtgggaagattgcatgaacccaggaggtccaggctgcagtgaggtgtgattgcaccaccacaatccagcctgggcaacagagcaagaccctgcctctgaaacaagaaacaaagtgcaccagtgtgtggattccagcttctcctggtgtgtggacctgacctcactcagccccatcagtgagtaggaggcttcctgctgtcttccagaacactctcaccactacacctgtgttcctcctgcattctctggcaggctttgtgaggagacctgtcacctgcctctctggctgccctaaggcccagctcaaaccttccctgaccctgagaacctttttctgaagagtctttcccccacccataggccccctcatttcagagcttttggtggggtgagtacaaggatcgactctctgctaccagcctgggtagggtccctagggttgggtctctggatggcatatgagggtctagaccaggatccagatgcctgtaacctgaagggcaggccctcagctgccccaacttcatggagcccctcgtccagcctgaccttctgggataggcccagcccctgcatcctttggtcttggtccctgcagggaactctggttaccctggcttacctactttgactccaaaagtaatgctgacatcccccgtgagacacagtgacagactgagactaacgtagggttacgtggctcagagtcaccatggccaggcagagctcaggtcctagcactgttcagccctgcctcccgggttcaagtgattctcctgcctcagcctcccaagtaggtggaactacaggtgcatgccaccacacccggctaattttttgtagttttagtagagatggggtttcactgtgttagccagcgtggtcttgatctcctgacctcgtgatccgcccacctcaggctttcaaagtgttgagattacaggcctgagccactgcacccagcctccctaacactcttctagctctggtgccctgcagggtctcccttggagcacctggagcccaagaagctgtccctcacctttgcaatcccagggactcgccccctgatcatgatgaaggtggacccaaacccgctgaggggcctgaaggagcaaaggtcagcctctgcctcccacggcctctctgatgggggggatgttatcccagcagcatgagctgggagcagaattgggaggatggggggttttctctgtgggtagctctgggctccaaggtggagccctcttaacctggccgctcccctgtgactctccttagccccaggcaaagaaagcagcttgccggaggtcacctgtcagatagggaaagagtgggacctgggttctttctcacccagctgcagctctcccttcccccagccccttcccccaggtgatagagaacctggcaggctgtgtcccatagaagagttcactttccttctggtaagggatgggaaccagcttgggatgggagggatgaggggtctgggggctctcccagccctgcctcacatttgaaggatggcatctgggtgtcagcatggtttaggctagacggggcggccccgaggtttatagcctggcctcgggcaggatgctgccatgccaccttctcttctgcacgtcctgacctggcatcctacctaaaggtcctcaggtctcctgccccctgggcattgcccccactccctgcccagacacagctgtccttgtcctggactaatcttcagagattcttgtccagcccacagctttgctggacatcgcaggctgggccaggccccctgcccagcactaacatctctgtgtgtctcaaccagactgagctgcagcttcagggtcagggtaggctctgacttaattgacgtgacccaggacaaggggatttattgatggtgtcacatatgcttaagctcttggcctctatgatttctttggggcatgatacccctctgtcccatgcttaggtgcccacctgtggccacaagtacctttcttaccaccatccctacttgagatcggtgtccaggcacctgtggctccacgcagaacgctgagcacagagccaggcctgggcggatgttctgcaggggctgcaggagctgacagtcctgaccacccagcccgtggccatccattccctttcaccgtggctggctcttcatccaccatccttccaggggccaggcctgaacccaaactgacttttacctgccctggtcccccttgtgcctatcaggttcttggctgagcatgatgttcttgcccatttccttgattatcctcaaaaggtttatagaaccacttggggacatcacatctgtctaccaggtcctcaccagagacatgactgccttgggccgggcctgggatagtcaggggtcacactcacctgttgggacctagcttcagtggcttcaatctgggcaatggcctgatgggcggctgccccttctcctctgcttgggggaggcaggagaggaaggtcagggaggagatctgcttcctgcccacctgacactggttggaagcagggcgcccacctgtgcctgtctcaccttgctgcaggtgcatcggaggccgaacccctctcccgatctcctgcaggtgcagattccaggtttccagtgggtgtcagtgtgggctccagagctctcctggtcctagggaaccctgggctccatgaggccttcgcctagccagattgtttcccacactgtcacctccccaccctgtcacctccccaaacatggggctgcatgctctgtgccctgggtgggacattggaaggagtgccaccttccaggtttggatcacagtaaagcctctgccatggggatgtgctggccgagacagatggggttgaaccagtcatgatatgttggccttgggcaagtcatctgtgccttgcttccctttccccagcagccagaagggataatagcacctatttcacccatactcaagtgttcatttgttagcaggaactgagtcccggaggaggtgcaggtggagccattgaggcagcactgcagctggacctgggtctgagtcccagctcctggctgtgatatgcatcactctctccatttatttatctgaaagacagggctgtgctgttctggggtcactgtgagaatgcaactggcctgtgtgagttggtggtggcctcctgtgatagcttgaggtgggctggaggtgtgtcttgaatgccccctcacccccatggggaagacccacttagggaagactcaagtgtctgtatggaggaacccacattccctgcccctcagctgtcctctgtcccttcctagccccctctgctgtcctgcaggctctggcggtggccatccagcttggtggccatctggctgatccactcctccaggtggaccctctgtcctcatgtggtgcaggtcccattgtgccacctccagacaggccatgctagccccagggcctccgttccctgttacccagcccccacccccaggtacgtgccacctccctaaagcccactgtgtccaccagctgtgtttcaactctgtctctgagcaaggcctaacgcaaagcctgaaacagcctggcttgtagagggccaggagaccaaagcttgaagagagagtgacggtctcccagagcccacttagcctcagccccagggctgtgtccatgctgttcctggctccagtgagccaattctctcccctgacgcccgtaagggctccagtggtgatggaggtagctggagagaacaaggctgtcttaaccctccctccctgagaaggcccaacggggaacgttttaggcatcagggcattctggggggcatcttccagggacccctcctataccctgccctgccctggctctctagtgagaaattgcagttgcttggacagtggggctgacccaggacaaatgcatatattgggctggtcttcagggtgctggggtaggggcaggggcacttcagggataggaaggaggggcctgtgtgttccagaagtacagaggaacctggtgccggccgccgtcaacccctatgtgatgatctttctacccgccctctttcgtgtcttggtgctggctgctgtctttggccaggtaagctcatggtctgggctcctggggtccactcactgggcctccacactgcctgcaggtaggggagcctttgggccaggactatccttggctccccttccaggtggtgggttcaaagaccattcctgggttccaccaccgccaagcctcaatggtgtctcgatggtcacaggaactgctggggctttctaggttaagacccttgcctatcccggtgttcctccctgcagtagggggctgcaggggtcagcctcagtctctgccttgggagcctgccttaccttgcctgaactcaagcgatctgcctgccttggactcccaaagtgctgcaattataggcgtgagccactgcacccagcccagccttgactttgaaatatatgttgtacatccagacagcagtgaactctgggggaacaccaaagatgaggagaatgagagaagagatacctccaattaaaggagttaggaagagatgcttgaacttatgttttaaaaagtcaatgcaggttgggcacagtggctcgcacctgtacacacagcaccttgggaggctgaagtgggtgaacggctggagcctagaagtctgagaccaccctgggcaacatggcaaaaccccgtctgtacacaaaatacaataattagccaggcacggtggtgcctgtggtcccagctactcgggaggctgaggtgggaggtcgaggctgcagtgagctgagatccaccactccactgcagcctgggcgacagagtgacaccctgtcttaaaaaaaaaaaagtcactgttttggggttttctgggtgaaacctctgtttccataaaaaaagaaaaaggtcgagacagtgtgtattactgattcaaaatcataacctgatgcttagagtaaatcattgtatctattgtttcaaaaaccaacgtcaggattattaaaagttaattttattgggtttttctttaagcttggctgattcactcaggtctgtcacttccaagcccatgttttactactttgtaaccctatttggaaggaaagctgcagctcacattatgatccatcctgagatgaagagtttcacacatatacaccacatataccccccaccacagtatgacgacacagcaacccaaccttgggcaaatggtaccactgccagcaaatttttttctttattttaaatatttttactgtatttcttctaacagcagcaaatgcatttaacactttattgagattctcaacagctgccatttggtttgtatagcaaattgtttacaaagtaacttttttccatttttgatattttaatgaaaattatgttcttcagttttaaagctctgtccctctcccaaagaaaggttaataactaactaccaagtaatgattatttgggaaaagaagaaaagcaaaaccagcttgtaaacacttctggaacgtgggtaaggggccaaagtcaagaccttctgggcccagtgcaggtgctaggcttgcctcgggacaccatcagcacttccccatccacaacatcctcaacagctgggagccatgtgcagaccccagggggcttcctgttccacaagctcccctctctttttcctctccacccttgctgttgggcctcccttccaaatctgcctaacaaaggcagcaggatctttaatactgttcagctttgtcaatggagacaggatactctagaaagttgagagattccctggtccagtctgggggaggaaaaaatatgcagtgtagcatagatggttttacttgtccactcagacacatgctcatacttattagatggatgtatcagatgcttcaaaagtcctgatgtgtagtagcacaaaagctgcttgtaaaaaggaagttgcaaaatgataaaaatttctgcagcagttcaggctcctgatgacaaagctggttctgataagtagttcttttgacatgcacagcagctttcactgttaagtcctgtgttccagcggtttcatttagaccataggaagttgaaagcaaagtttaaatgttctctgctgacaaaatgtggtatatatccatcaatggacttctactcagtaatgaaaggaacaaactaccaaaacctgttatatgtcatggaccaacctcaaaaaccttagctaagtaaaaagccagacatgtgaccacatattgtataattctgttgatttgaaatgtccaaaaaaggcaagttgatagagacagaaatggtctgatttacctcaagaagtagggattcaagctcttagggtacatgtgatacatacattagaagaaataaggaaaagaaaagaaatttatatgtaaataaatgaaaataatacttctccctgattataaagaaaattgcattctttttgtaataatttggaagacaaaatatgaagaaaagtctttaattttgccactgaaagcattctggtttgttgctttttatatttttttatgcatatgaacattttaaaaagtagaatcgtaatatatagtcttttgtcactatgttttgggcatatttctatggcagtaaatatatccttggcatcatctttttaaaagctcgatgtgtattaagttaatcattgccaccccagaagtaaattttcttatatatatattttaatggacgcaagcaagcattttggggctgaagtcatagaagtagaatttctggagaaaaataacataaaatagttttaagatttttaatagaaattttcaaattatcctgcagaaaaattggttcagtttatactcccaacaggggcagagctccagtatcccgtttccatttgtcctctttgctgatatttaaggagaaaatctcattgttttcattgtatttctttggtttctagtgcttttgaaacttttttttttttttgagatggagtcttgctctatggcccaggctggtgtgcaacagtgcaatctcggataactgcaacctctgcctcctgggttcaagcgattctcctgcctcagcttcccgagtagctgggattacaggtgcccaccgccatgcctggctaatttttgtattttttagtagagatgggatttcaccatgttggtcaggcccgtctcaaactcttgacctcaggtgatccacccacctcggcctcctaaagtgctgggattacaggcgtgagccacggccctggccttgaatcatttttatgtgcttattggccatttttattcttgtgggaagtgcctgtttctccattgcctattttctggccaagctcccaagtcacatttcacttaatttttatcctgctgattgaaagcattttaacataaacaggagcaggacagactgtaattatctagatcttgctctgtcacccaggctggagtgcagtggcatgatcatagctaccacagcgtcgtactcctgagctgaagcagttttcatacatcagccttccaagtagctaggactacaggtgtgtgccaccacccccagctaatttttaagattttttgtagagatgcgaattcactatgctgcccaggctggtcttgaactcctgacttaaagtgatcctcccaccttggcttgccaaagtgttgggattacaggtgtgaactactgctcctggccgagggctcattttgtttgctagtggtgatattggtatctgtttatatttgaggctttggtgctagtgctgatgtattacactcaccatccgaggtttgcaggacttttgttttaatattgaatagatggaactgtttacttctgcatctttgcaggcatacaaaatgtgcctaccaggactctgctttatatctatcgaaagcaagaagtaatacagtaaaactttgcctggctagaggctttggaagaatggagtattctgatttaatgctattgaagtgtgaaggtgaaaagaatgaaaaacttacatttcctgttgaatgcaacttgaaaatacagccagtgattccacttttcttctctagtaagtttggacattctgatctacttggtgttttattatagaactgctagtgtgcccgagacttacattgtgaagacactttttaaaaaacttgagaggtaagagggtgtaaatggtattgtgtgagatcaggctggatgagaactgacacttgtaaacatactttttaggctgaatctctgattgccgtttgttttcttatttaactcataaaaataaaacacattggatggagggtgggagcaggaaggagatttatgtcttttaattgcatgccattgtttcatatcaagacagaacatatggtatccctggctttggacctacagaaggaaacacatttttctgcctgctgtatgccagaggttcttgaacacctggagggatgactgcagcacagattgctgagccctactccagagtttctgattcaccatgtccagggtggggcctgagaatttgcacttacaaaaggttctcaggttctgctgctgctgctagtccagagactacatttttgagaaccactcttgtctactaactgtaaattgtagaactctagaacaaagcttagtttggtgtaggaaaagaagctcacaggttatggagcaaatcatgaaagattcaacccttgatcccagcctagtgtggaattcaggtaacaatcaatacacagtgacataacacaattcttggttttcatgattgcaagtcatagccaagtatcaagtgagaaattcagtttcatttgcaaggcttagagaggccaggtgattctagaaaaataggccttgtatttgctttaaaccagtaaagagctttgagtgcttattaaatggaaagctttgtgtttttatttatttttgactattttattttatttttttgagatggagtctcagtctgtcacccaggctggagtgcagtggcgtgaccttggctcactgcaacttccgcctcccgggttcaagtgattctcctgcctcagcctccccagtagctgggattacgggtacccaccaccacacctggctagtttttgtatttcgagtagagacagggtttcaccatgttggccaggctggtcttgaactcctgacctaaggtgatccacccacctaggcctcccaaagtgctgggattacaggtgtgagccaccacacccggcccaaaagctttgtgtttttaaagatattagacatgtttcttgttttttaaaaaatcttaataatgtaggagaataagagaaatgttttttccaaagccgagaaatcattgtgattattttaccttattgggatgttggataatatagtccacttcattcattaatcatcaaacatgctatggattttccatttttataggatttgtgtcttaactggggtaatactggtaattcttatactccctctgaagatgaaaaatgtaggccaaaatcatagaccatgcatagaagctggataatgaagacagctctggaggaacatgtagacacacacacactgacacacatatatataaagtataaatacatatttttttaaagtttatttttaacattttaaagcaaaaaccagccctcccctctcccggagtaggcaggccccgcccctctccccaagtgggcagggacagcagtcgcatgggcagctttccttgtgatgtcacaggttcctctgggcacactgctgcctggccacgcctcctttccctttcatctttctcattgaccaatgggattggagcattaaggccacacccctattctgcattctagtgtggccctggttacgcctcctctggctcagtcacacagcagccttgtaggtgactggaggtgttcgctgatgtggccccaaccctacctccctccccaccccatgatgttagaagaatctcgacagaataaattggcagcagccaagaaaaaggtaaaaagccaagaaaaaggtcatggccccccaacctagccagagatcccctctgatgacaagaccactcccagagtccataccactcctgaggcacaccgggctgggcccccctaccccggcgcctctggactccccccaccaacgtcttgtcagtcagccccgccccttcagcaagcagcccagcctctgccctcgccaatcaccctgcggtgactttgggcggatgactactggggatacctgctccatattcagccctcacgtcctgccaccccaagcccaacctccctgggttctttgggctcacctctccaaggacctgggtcccccagccccaaccccccagcatcgccagtcatcccggggtgactttgggctggtgactcctggggttccctgagcagactctgctctcccctcctgctgacccaagcccgacctccctgggctctctggactggcatctccaaggacctgggtcccagccccacgtcccccctcccccatcgtggatcggcaactcagccattgcactgatgaggtttcccccacccccaggaggagtggaatgtagtgatgtcacagtcctcctaggaactgtcattactgctgcaagaccggcctttgatcttataacccagtcccctaagcattctcaccccatttctggttcctctggtcacagcacaaatttccagctagaagggaaatggggaccatgggacctaggagcaagaggtttcaggctgccttactcccttcacatagacatcgacagtgtgaaaagcctacacttcccctgtgagctcaaaacgttgacagtatctctgggtggtaatgggagaatgggtttggtttggttttctcccaggcttctactctccagagagactttaacatttttttccgagttctccacctcatattctaattctccacggttctgggaccagactgcccttcagtcagtggtctctgaagtgagatttgctcatcttctgtggaataggtcttgggaaactgaacttgacagcttgaatcttcctcatatcatctcaacttagggtacattgagtgccacaggataaatgtgggagatctttctgaagcatcagtttcccttgagtctcttgagagagaaaaaacattaatgtacttaggggtgaccctcacataggtttctaagagtataccagacttctctctgaaatgagacttgggttgtcctctttctgataaattcccagatttaacaaaaaagctgccttctgccatgaggacacattgatataaaagtttgagagatactggtgcacttcttcacactaacagacatttgaggatgtatgactctaaaccacacagcgtgtagttcatgcctatgtaatgtttacttttctacctctgcgtctggttttggtccccggcagctgctgattcatggcaaaaccccagagcttggagtcagaagactgagtttaagttccattattgcccccccacacttttttttttagccataatatccatccctctcagtcacttaagtgattgtgacaacaccttgtacagttgttggtggcattaaatcagatggtgtataagagtattttgcaaaaactgtaaggagggtgtggctgtaagggctggtagttctcatgagtattactgctcttctttcccacagctaaaagaatatcagcaaaggaagagccctggtattccagcaggagcaaagacaaaaaagaaaaaaactgacagtagccctgagacaaccacttccggtggtggccactcacctggggatgtgagtcttggctggccaggctcctggggacagggggcccaaggggcagtagagggtaattgttgagattgctgggtactggttaagaattctgggtttgaatcctgcttcttcatctgctagcgatctgatttatggcaagttgcttgagctctttgggcctctcttttcacatctgtaaaataggggtagtattgtttgacttccatttgtgaagtttaaatgagattccttattgttgttgttttcatgttaacccctagtacgtggcctgctgtaaacacccgggatacccaggaaatggtcattgctgtttgattttcctgatccccactcgcaaggggaagctgggctaatgagtacagccacttgccatcaggctgtccctctaggagtcactgaagggggcccagggtgtggtgaggagagcccaaggcactaggagcaagagaaggtctaacttgccaccagcttgctgggtgaccacagaaaaatcacttcttctgctgggcctcagtttcctcctctgtaagatgatactggataagatcagtgtctttcaaacttgttttttagctgaagtccccttagttcaagtgaactcttactcaggagtctgtttttttttaatggaggtggaggtctggagctctaccagattcatcgcccatgtcctgggcctgaggagaggggtccagtgagcgtattaagatctgcattggtcagctgactccactctgtgactgcgtcactcgggggacttttccatctatttttttcctgcccctggcaaggcagcaggtggccatttggaagaatggcacaggccatggttttaatctcctctgctcttcttcagcgtttccttttcctgaacccacatcttcctcctaccctgactttcttgcttctctctaagccacttctgtctttcaccccctgcccttgtttttcccttgtcacctcctgtagattcaggacattctgaaggtgcgggtgtccaaccttaaccactccaatggggtagtgctcccccattggacaagtggaaggtgaggcagtgccaagacccctctctggcttgctgtctacagctgtgcatggccctgaggcttctctggcttgggggatgcttggcctctgccttgttttatgttgctgccattaaccttcagcctgtttctgtctgcttcttcacctgcttgattgattgggttttttccttccccgcgtcttttattatcttggaaatggtgacgcctaaaagtttaaaagtaatctgggaataacgtacagagcaggcatgtgggatttgggctctttttttttttttttttttttttttttttgagacagagtctcactctgtcactcagactggagtggagtggtgcgatctcggctcactacaacctctgcctcccgggttcaagtgattctcttgccttagcctcctgagtagctgggattacaggcacctgccactacgcctggctactctttgtatttttagtagagatgcagtttcaccatgtcggccaggctgatcttgatctcctgacctcaagtgatccacttgtctcagcctcctgaactgctgggattacatgtgtgagccactgtgcccggctccttgctgtttttatactttctccatatacataactatttcccatgtaagtttttttttaatttctcatttttattactcctgcatcatctgttaccctgaaggatctggaagtaagaggccctgggctgaggtgcagtgactttgcaggccagccctccaacctcctctcacagtgggggctgggtgaccctctgccagctgagacagcccacacacaccccagccctaatgattgttctctctacctctccccacaatcctcttccaactcctcctctctgcatgtgcctcagagccagtaccaagaactagcagtagccctggagtcaagctcagtgacaatcagtcaactcaatgaaaacatagaatcattggtaagtccagtggggtcccctgattccatgctgccaatcctgggctttagtttccccttggggccctgaagaaaggggctgggggcccctggtgccaagggcaaatggggagctggagcacccaggcctcacctggagggaccccagagcaaggagcacgcagcatggctcttctgtcactgccctctttgccgactctctcttctccagacacccctgctccagtccttgccacacacgccctgaggttgtcacctctcagggaagcgctagcctgactggttgtcaggggccctgtatttctgccctgactcagtccctaatttgctttgagtctggacaagccacctgtcctccttgggcttgtgtttctggaggaggtagagcatcagagttctctgttagctctgagagcctgagatttaaaggcccctagaatggaaacctgagggccaagggctcctgtctgtccttttccatcctatatctgctgtgaagaaccgtagctggcccgtatgtgttcagtaaatgtttgttgaatgaaggcacctttctaaatcacaagctggcagaagggtgggccttcctgagactccctctctaggggtttatgttactgtcctttcaagagaatccagattcagacttcgagttctgtggctgtgggcaaaaaccaacaaagacccaagtcctctgtccttgggagcttgaagagggttgaccagtttgtgttgccattggttctgagaatgttgcctttaaaatccattcctggaccctgcctaccgcttccaggtctggggaatagagttgagggggccactctcagtcacctgaatttgactctccccacagaaacagcagaagaaacaagtggaacatcagctggaagaagtaacgtgatttctttgctcacaacatgactgctgggtttgggggacactcagatgcagaggcgccagtctcatcttgcccactcccagcctggggaagaaggctcacccatcagattccaccccatccccacagggtccctgataacctggtcccatgggtgggcctgtcctggggcattggtggcattctgggggcatgtctcttgctgtgccatctctgcctccctgtgataagagctctgtcttcctcttcctacaggcaaagaaaacaaacaatgaaatacacaaagcacaaatggagcggttagaggtgagtggagggtggggagctttctcctgtcctctggagaatgtttctttccttctctttcagcatttccttggcttttctcccaaacgttcaattccagacaatcaacatcctcacattggaaaaggcagacttgaagaccaccctttaccatactaaacgtgctgcccgacacttcgaaggtgggaatctgggcatcccgtcatccttcaacctggcactttgacaggtctttagggggagtcttttgggccccatctcaacctctctcattacagaagagtccaaggatctggctggccgcctgcaatactccttacagcgtattcaagaattggagcgggctctctgtgctgtgtctacacagcagcaggaagaggacagggtgagtccaaccagctgccccatcccctggcagcctggcttcccagatagaggagtgagcctaaaggtcccttctgcaggatggagtgtcctgcccagaaggcagcatggtcatttctcactacttttgtgtatggttgttagaggcagcctggggctgagtcagctgctgtgggtgagttggggggcactgtggggagtgagcactggatgcagagctcagaggccaagtgcctgccctgccctttcctggctgtggccttggccaagtcctaggtggggtattgggtagttgttctgtgaaggtacagaagagcacctttagtatgttaccatttctgtagagagaggaaaggggtgtgtgtgtgtgtgtgtgtgtgtgtgtgtgtgtactatgataatatacaaaaacatgtctgcaagcattcataaaaaactcaggagagagtaacagggtgcctggagacacctcccttctgtaccttctgagttttggactatatgaatgtatcatcctttcaaaaagtgaacaaaagattaatttcccccttcctatctgtgtccccacccccagcaagaaaaatgggcttagagaataggatagacctgggtgttcaaatcccagctctgtctaagtgatcttaggcaatcacttaaccttgaacactcgatgtttttcatctacacaatagaggtaatcctagtaactgtctcatatggtggttgtgaggattaaatgggatcgctagcatggaacctggtgaagcactccataacggttcaaacagtggtagtaataacagtaataacaatagcaatattatctgatctctctgggcctctgttagccagctgtaaattctatctctttccctctcccttccaactttactgagttcttttaataaccaggccacgggcttggaaatgccttgacctttactgaccgagttgtatattgagcctagccctagcccttttaaggggcactgcctgagctccccagatcaaaacttctcactcttcaccatccagtcctcgagctgcagagaagcggtcctccaccggcggttacagcagaccataaaggagcgggcgctgctgaacgcacacgtgacacaggtgaggctttgcagagggagggatgtggaaggaagatgaccccaggtggccaggagcaggtgaggaccagtgacagcccttcctaacttctgtgcccatttcttgcaggtgacagagtcactaaaacaagtccagctagagcgagacgaatatgctaaacacataaaaggagagagggcccggtggcaggagaggatgtggaaaatgtcggtggaggtgaggtctgacccttcagcccccactttagataggtcactggatctttctgggcatctgtaaaatgggaatagtacagccagaggtggtcatgggtctgggctttgtggagatggggacagagaatgagatggtagcctgtccagccaccagcccctctctccagggccctttcccctgtgctttgggcaggctcgaacattgaaggaagagaagaagcgtgacatacatcggatacaggagctggagaggagcttgtccgaactcaaaaaccagatgggtaagatggggctggtgtgacctcggagcaggactggcatcagaggtctgtgggggtggcttagaatgccccagggaggtgggtgggtggaagggctttgaggcagagggaaagaggtctgtgccaggagacggcaagttttgtcatctccatgagcctcagggtccccatcagcaaagagggaggagtgcccgttgtcagccacccacagtgctctctatgtgaaagtggcttggaaattggctaccattgggtgcgaggaatgattagcagtgaggccaagtttgggaagcctgagaggagctgtgcatcaagaggaggttttttttttttttttttttgagggggatgtgggtagaggggttggggaatccagaggcccttattgtctgcttcatttctcagctaagcccccatccctggcgcccccagcagtgacctctgtggtggaacagctacaagatgaggccaaacacctgaggcaggaggtggaaggtctggagggaaagctccaatcccaggtggaaaacaatcaggccttgagtctccttagcaaggaacaaaagcagagactccaggagcaggaggagatgctccgagagcaggaggtgcagagagtgcgggagcaggagagactgtgtgaacaaaacgagaggcttcgggagcagcagaagacgctacaggagcagggtgagaggctgcgaaagcaggagcagaggctacgcaaacaggaggagaggctgcgaaaggaggaggagaggctgcaaaagcaggaaaagaggctgtgggaccaggaggagaggctgtggaagaaggaggagaggctacaaaagcaggaggagaggctcgcgctctcccagaaccacaagctcgacaagcagctggccgagccacagtgcagcttcgaggatctggtgggttgccccacctggggagcctgccctcatccctatccctccaggcctttgtttccccacctgtaaaatgggccagtgtagccctcacatgaaatggtacttctaaaggcacctgtgagctacagctcatcgggctctgctctgatggctgtgggggagaagggatgatttttctaacctgcctccacccttcctggtgatatgggaggcagacaccaaggtctggtgtctccagctgcagtggatggccactgattgcttctctctgtccagaacaacgagaaaaagagcgcactgcagttggagcagcaagtaaaggagctgcaggagaagctagacgaggtgaaggagatggtaacctccaccccatccaagaagggctgggaggcgggcaccagcctctggggaggggaggtgccaggccaaaggcagctccagctgggaggcaggtgaccccagcaccctccagtgcagctctatgactgtttcttgcttcctgccctctgacttttagaggtgggtagccctgggctcctcccaggtctggacatcatcatcccagctagagacatggagcccccaatcataggggaagagacagtggtacaagaggctccttatccaggcacggtggctcgcacctgtaatcccagcactttgggaggctgaggcaggagaatcacttgaggtcaggagtttgagaccagcctggccaacgtggcgaaacctcacccctactaaaattacaacaacaacaacaaaaaattagccaggcatggtggcgcatgcctgtaatcccagctactcaggaggctgaggcacgagaatcgcttgagcccacgtggtggaggttgcagtgagctgagattgcaccactgcactccagcctgggccacagagtgacactgtctcaaaacaaaacaaaaaagcctccttagattcaaactggattctggcctgggttccactggtcaccattcaactactgttcatctctaagtctctgtttctgtgacttcaaaaggaagttagcattttccttgcagaggtgctgaggattgaatgagagaatacctggaaagcattaggcatgtagcacacttagcagatggtggttggctccctctgcttttccgccagtctgtggcctacagtttaaatggtgggaagaaggacatgagatttgaggctggggaaggaggtatggggttctaggcaagagaggaagcctcttaggcctggagcaagggaccagggtcctgggcaggtgacagagccccacggtgccctcgctaccctattaatgggcccagaatctggaagccagccaccatgtgccctcatgcccagggtcttcctgcaggtggagctgaagagccaagggtctcagagtctgcagcagcagcgagactagtacctgggtcacctgcagcagtacgtggccacctatcagcagctgacctctgagaaggaggcgctgcacaggcagttactgctgcagacccagctcgtggaccagctgcagcagcaggaagcttggggcaaagcggtggctgagatggccggccaaaagttgcaggagacccaggggaggcagttgctgaggacggggccccgagggggatgacctggcaacctccgtgccttctcactctgtttcccgtccccttaggagcacctagaagctgccagccagcagaaccaacagctagagacccagctaagcctcgtggctctcccgggagaaggtacaggagaccactcagaggaagaggagagagccccaggaggaaggggggactgttagcagcataggattgaggggttggaagagacctttagaacagctggtcgttatgccaaccgggtgtccgcactaagttcagcatcaatatggtgacctcctgggagcagggggccaccaggttgcctaaggatgaatgaactggaccagatcagaaagggagcaggtcaggactcccgcaccgaccggtagtgggactgtgcctgggcaatatagcaagatcttggttcttaaaaggaaaaataaagaacagcagctcactcccctctggggagaggctggctcagggttacacagtcagggtggggacagaggtaggcccacaggaccttccttgttgggttgtctgaggacccctctggccacctccctacaggagatggaggacaacatctggacagtgaggaggaggaggcgcctcggcccacgccaaacatcccagaggacctggagagccgggaggccacggtgagcctgactttccctgccccgctttgccaccttcctctgtggtccctcccagacccccttatgctcttggtttcccaccttctgattgctctggcccctcaccccttccgggagccagtggtcagacactttgtcacctgtgaccaacaggtgcactctctgaggccccaagggaaggggttgttctccacctccctgcctcatttgttctgtctatgcccctacaagaatactcacctcttgccttcaagtggcatttttcacctctgctggagccagttcccaggaggagcaggcacggctatgtgggcagcggaaggtgtgaaggctgtgctgcctgcacctggctcatctgttggccttggcctggaaggagccagaggcagaggccccagccccagggagtgggggtgagtttgtgtgtggggagagctaccgggccctgaaggaggccatggtgaagctgaaagggagtgagtcctggcatgggccaagaaaagtgggggcggggcagaacaggtcactcccgagatgtgaccccattattttggctccagagcagctttatggacctcccgaaggagaaggcggacgggacggagcagtggagagacgagagcttggattcgtccagccttctggagtgacagacggcatgagtgagcgggaggccagggcacgggcacggggagctgcagggccgtcggagggaccctagtgtctgagctgtgtcctctcacaggagagtccttcaccgtatatgaaagccagggggcagtgccaaacacgcggcaccaggagatggaggatgtcatcaggctggcccagaaggaggaggagatgaaggtagggcgtgcaacatctctgcgggggtgggggtgggcatgggcgctggtgcaggctccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatggtgagtagagctctcaggcggggtgggcaggcaggggcaggggaggctcgcactgtgctcagacccccgcctccctctctctgaagatttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctgatcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggcatcctttagcatttttatttttaatttgataattgtaggtcattagtatgcatatcgagtttgcccttaggtggtgggaattcaaacacacaaagacccactaatttgcacaaaactattctggctggtttggaacaggctgccatgcttttttaatgttattgcagcatgtatattcattccagaattcagataaaatgtgcttatgttctgctatgacgtttgatcgaatcctaaccacagtgagctcttcattagctcaatatgtggtttgccctcaattgagcactgtttattactttgtaatatgccactgtgagtactgacatttagagttgtttaaaggccaagaactggaaacagccttttccctattttctgtgtattggggatgggagtaataacattttggggagctttttaaatctcacagaagaggaaagtggcctgctctggcaggtgtgtgcaggatagagtgtgtttcatttgttctggtgccaagaatgagcgctgtactatggtagttcccttaggatttgtatgtgctctgggctcatgaagatattgcatcatgagctgcagcagttgtaccctttcttgatgacctaaaaagggattatttctgaggaatgaaaggctcccatcattgactgtggatgtggaaaaccttttctagcttagagcatttatatctacaatacattttaaagtcagagttcatgttacctgttttaatcacatgagtatatgtcccagtacacaaaagggcactggttggcattcttcttaaggtatttagtgaagatcataagaaatcctttaagagtttaaatgtccctggaagaggcatacaggctctagtcaagaatgaattcgagtgaaggaaagctgtgtgacacctggccttcctctatgttcatggagcttctttgaggctagaagattgattttatcatctagacctctctggctaatacctattcttcagccacattagttactctgacgtaggaatttacttcttttctttgaatggaaaacactttaaaaataataacaaccattattataaaccaatatatgtgagagtacttagttgaaacaaaaaggagttttagtagacagtattatactacacatgaaaatcaaggcgaagtttatgcaacttaaaatgtttacaagctgcagtgcaatctaatgtttgcgaatgtccaagtattatgagaaaaagtgtctatacaatgacagacttacgtttcctcacaaagttcttcacaaagagtgaaatatgtttttatacctctcagtttcagttagaggcatattttgtgccatatttatgttaatgtgcctatacgtgatgagtgaattatttcagtcatacattgcctaaatcataactttaagatgcttgggaaagaatcaacagctaaaagttcatgaagttctaatgtctgtgttccaaaatacgtcacagtattaggatgcagggagagatgtgtgtgcgctccctggggtgggcatttctagttactagaccatctccatttttagcatttggcatcctcatgatacttttatacatatgacgttaataggagagcaataatacgattttacagatggaataacagatgtgcctgcattcagtgaaagagtgcaaatattaagtccttgtgacttcaactgactcttccaaattgtatgaatttatcaatgtattagataaactcagttccagaattataaagaaaaactgttagaccaacgaatgtggctaattaacagtaggacgatttctagcccgagggtttaaaatggacttcaagtcctgttcttgccttttattttctgaacttgccacttttgcattctttgagttcagtttaaagacagtttgagtccaatttagaccctcgggctagaaatcataccactgttaattagccaccttatttggtctaacagtttttctttataattctgaaactgggtttacctaatacattgataaattatttcaaaggtatttttatagttcaaatcacttcacttttaccctgataaatataaatgactaggaatgatcttcagctagcctttagcacctgcaaccaatcggacaataatgtgttcatcaggtacctgtggattaaatcacacaccggcatatttaagctgaatgtcagtctggaaaatgaatgtactatattaactgaaataccactctttgtgtaggtattctgtcatatatttaagaaaaattaaatagcatgtaaatcatataacaacaacttaagtctttcttcaaagtgcatgtggtcctttgcaatacctcattcagccaagtatttgttctcttcctcattcagtttaaggcagctttcaatttgcttagaaggcaacattagaagggtagagtttaatcagaaacatagaattttaaagtgtgggttcaactgaataaatttgaatttctgtaggaagtaaagaattaaaaatctatttaaagattgcaatatataatcatttttaaagtatttgtttaacctgatgggttttccagaaatgaaaacaagtcagttctaaaaccaaagctgatatttagaaaatgtgaaaatgtaaatcagccctatccataatatagtttctctaaaactttatcttaaagagtcattttaaaagaatataactattcataagtgtaactgctatcttaatgttttgaaataagttaaaacactttaaaatatgaatactgtagtttgaaagaaagaaactgggggaaggaaaagtagagaaagaaatgccaattccaatgcaaggctttatttgccaagttttcttagaatgacttttaccagtttatgaattcttgtaaacagaatgtataatagaaatactgaaacactgttgcctaaagtggcattgttgactgctactgtgatgctactgtaatgtaataaattattaaatggttgcaaagtgctgtttttgccttaaaattttgtgtgtcttgaaaactatagtattacaggtattgagactgtgcaaatgctgggcacgcttggcatgagataatcagtttttatttttacaaaattgtaattaactatgcaagtgtgtttattaaaagaatacaaactaaaaagaagttatgggatttagaaaatgttgtaggatgaaaaagttatgggataaaaaatgtggaaaagtcgtggcaaaaaaagttgtgaaaaaagtatttaaagttttatgaaaagtttaaaaaaagtattatgaaaaagaagttacgggattaaaaaataagtcatgggatataaataaaaataaataaaagcaggcctctgtcagcataagcctggagaagtggggctggagtctctgccgccatcgtgtccctaccatcccttcctacccctttatcattagggtagcaagacaagacccctgtctaatggggggagacaaacagaccctttgccaccttgaccagggctgagtccttaaatttctggatgatgatgattgttatttaagagccagaggctggtggagtcggtttgtttggaggcggcctgatggcctccctaccctcaccaaagcaacttttccctcagggggctcccatcttcttattcagagaggcagctgaggcagggacaatggggctaactgtagagcaggtgagggcacgggctgctgggaaggccccagtgtacatatagtatctgtgtaacattttgtatattccagggggtagggccaccccctgtatcgtacctagcagaggttggagctggcatatgaggaggaggttctaatcattatttgtggctgggaaacttatttattgatagcatggggcagaggaaggaggcggggatggggttgtggctccctggtgatgcgactcctgtttattttgcctttcattttggaataaatggatttagccatactgctcagcctggtgtgttcctttttccctcactgggtcctggagtttgtgccactgaatgaggagccccagagttgtctgagcatgtccagctgggctgttggtgaccttccaggcctgttacctttatgctgcctagtgacacctggtggatttcattgggactgccatggcgcctatggggcacagtccagccctgacagccaacaggctcagaagcctgatctagcggtggccgggaagacagatactagcacccaagggcactgacttccattcaccccaggagtcttccattccgtccccctccctccttctcctgtctgcactgggtggcctgttctgtctgtccctccagtgcacctggtgacctgttctgtctgtccctccagagtgccagctgccctgcaggctcctcgaggctgagttcatggccctgcccctagtggccagagccggcttcacaggataacagccagctaagctccaggggctttccaggaaaagtgtcccttgaaaagggtgtggctttttcactgctcccaacagcaccctagaaatggcttggccttttccctcccctgagttccaaaaagaacacagccagcagaggacacattccctgacatacgagggactggaagactggtagagatgtcaggtcacaggctgccagcacagcacccccatgattggccacgggagtgctggaggaatggtgggggttggctgtccactggctgggcatgacagggagactcactggaggtggtgcactttggaggggcgatgtcagggatgtatttgggtctcagtaaagagatctgttctttttaaatttctgcatctagttgcctatacgcgatgatgacacatagcaacttattttttactttctaaagacaggatatcatgcaaagagatcaagctgcccttctataaatataactcaattgccttccagccataggctgcatgcttcaagttgttttcagaaataagaaatgggttgagctgaaccacttatagccttacatggagagttcccactgtgacctgtagcacatgtgaattgacttgcttaatgtatgaaaccaatggaaatgagatgaaaagtcctattctcatgcaagcccgttgggttatgcagagacacagtagcagagacacagccctaactacagcctgccctccggaaaacatgtgtctgttcatatggaaatgacacaagtctagtgcttgtctgaaagtcatgcagcaaaacaaaaaaagtctctgcaaaaccggggagagttttttacaatgactttaactttgagggtgctctttagcagaggcttttgataaaggaagaattctatcaaccaggatcactgaggaggaatgaatttataactactctttttaaggctagaagagaccttaattaaattccttctatttacaaaggagggaactgaagtccagaaatgacaaaaggtttggcagctttagaaataaggcaacattgagtttcagtattctaaacttttggaaagtggtaaaaatgaaggatattgaacaaaaaatactagttgttttttttctatcttgttcagttagtgtcaacatgctgtaagttttcataatttttttttttttgagatggagtttgactcttgttgcccaggctggagtacaatggtgcgatctcagctcactgcaacctccgcctcctgggttcaagcgattctcatgcctcagcctcctgagtagctaggattacaggcatgcaccaccacgcctggctaattttgtattttttaaatagatagggtttcttcatgttgatcaggctggtcttgaactctcaacctcaggtgatccacctgcctcagcctcccaaagtgctgggattacaggcgtgagccactgtgcccagcctatttttttttttttttttgagacggagtcttgctctgttgcccaggctggagtgcagtgacgcaatcttggctcactgcaacctctgcctcacaggttcaagaaattctcctgcctcagcctcccgagtagctgggactacaggcgtacactgccacgcccggctaatttttttttgtattttagtagagacggggtttgactgtgtggcccaggctggtctcaaactcctgagtttaggcaatccacccacctcagcctcgcaaagtgctaggattacaggcatgagccaccgcaccctgcctggttaatttttatgataataaaaatattctcataaaatttgggaaattccaaaacctatggagaagaaaatttaaattattcatcatcccacaatttattcatttgcttatttgagcaacaaataaaagtgcacaccttattaagagcagggcatgttccaagactgactatccagaaatgattgatagcctctaactgattcccttccaacccatttctcagtgcactactactaataattttaaaatcagattatttagttttgaaatctccttttcacctaatatatcataagccttttcccaggttatcaaataatattccaagctatgattttaacagctgcataacgtcacatcatataaatttacactgatttattaaaccattgtacttgggacataataagatgatcaatttttcaatattataaataatgttgcatgtaacattctttggccacatgcctgattatctttgaaaacttccctagaattcagattgttagatcaaagccttaaatatttttaaggtcttaaatacacaatactcaactgctttcttgaaagactgtaatagttttacttctaccagctacaagagtgtctttcagtcatgcaacaaagcccacacctcaaaacaatgagtattagctttaaaaaagtcattgtcaactgagttcaaatggtttttcctttaatttgcagttcttacttggcaatggttaagtcaaactttccaaaaaaaactttgttctcttttttcataaattatatatgcatgctttttgtcattttctatggaactgttaacatttcttcttagcattctagtcttaatatttctcagtgagggatttttctgactgcattctgagatctaggctcctggctggggcagcaagaggtgggatggagaaagggcggggagtcagagtcaggcttgttctcttagtccttccacaatcaccaaggtgtgacctgggccaactcttggtatctctgggcttcagtttcctcctctgtaaatagaagggtcttaattaaggtcccttccagtcgtataaaagggagttagagatccgtagtttcaaagcttctttcactatcatgatttgtgatcagctttgaaggaggtagtgctagtgggtaaacatcaaaccataagcttgtttgccagttctaacctaccactaccacctaccactgagaaaatcatttcaaggctcttagtttcctgatctgtaaatggaaacctcgttttacagatttgttgtaaaaattatgtgaaataatagaaatcaggccaggtgcggtggctcacacctgtaatcccagcactttgggaggctgaggcgggtggatcacctgaggttgggagtttgagaccagcctgaccaacatggagaaaccctatgtgtactaaaaatgcaaaattagccgggcatggtggcgcatgcctgtaattccatctacttgggaggctgaggcaggagaattgcttgaactcaggaggtggaggttgcagtgagccgagatcatgccattgcactccatcctgggcaataaaagtaaactccatctcaaaaataataataataatagaaatcaaagtgtatagagcataatataccacagacaggcaggatgcagtggctcctgcctgtaatcccagcactttgggaggccgaggcgggtggatcatctgaggtcagcagttcgagaccagcctggccaacatggtgaaaccccgtctctactaaaaatacaaaaattagctgggcatggtggtgagtgactgtaatcccagctacttgggaggctgaggcaggagaatagcttgaacctgggaggtggaggctgcagtgagctgagatcgtgccattgcactccagcctgggcgacaagaacaaaactctgtctgaaaaaggaagaaagaaaggaaggaaggaaggaaggaaggaaggaaggaaagaaggaaggaaggaaggagagagagagagagagaaagaaagaaacaaagaaagaaagaaagaaacaaagaaagagggaaggaaggaaggagaccatattcatactagtagctgcttatgactaatagaagtaaggatgaggattagaagggatttcaactttataatacattctttcctttatataataataatgaaaaagacagccagtcacagtagctcatgcctgtaaccctagtgctttggctaaggtgggaggatcatttgagctcaggaatttgagaccagcctgggccaccgagcaagactccatctctacaaaaactttaaaacaattagccatgtatggtagcctgtgcctctagtcccagctactagggaggctaaggcaagaaaatcatgtcagcccaggatgtcgaggctgcagtgagctatgctagtgccactgcacctgcactccagcctgggtgacagagtgagaccttgtctcccttttaaaaaaaaatgaagcaaatataacaaaatattaacaacagtcagtgttgattctgtggtaggaacatagttgtttgcaagatcatgctctgtacttttccgtatcttaaaaaatttcctggccaggtgcggtggctcatgcctgtaatcccagcacttagggaggccaaggcaggctaatcacgaggtcaggagtttgagatcatcctggccaacatggtgaaaccccgtctctactaaagatacaaaaaattagccgggcgtgatggcgcgtatctgtaatcccagctactcgggagactgaggcaggagaattgcttgaatctgggaggcagaggttgcagtgagccgacattgtgccattgcacttcggcctgggcaacagggccgaagttgcactccagcctgggcgacaagtgcagcccatctcaaaaaagaaaaaaaaaattcccccttcccatacaaatatgcctagctcataaaagcaatcctaaaagattacatacagtatgtgtgtaattttttacttttttcttatttttagagtttattaagcaggggagtggagggaagatgtggcacaaatagaaatatgtaacattcaaacaacagaatctgggatttttgaaaaaatctttcagttatggttacaggaagggtcacttcctcccccaacgacacagggacctctcaaaggagaggagagagtaagtcccatggtagggccagtggttgctcctgggttttggaatgatttctgcagagttttcaagaccctgggctcagggtggagacttcatagcggtggcagctagacccagcaagatggctgcaatggtgaagccctgggcggcgatctgggtgtgcatcataagccgtgaacattggctgttgccctggtggaagcagtagaggccgttggtgaggacggccgccgtgcacaggaaacctatgggtaccaccggattctcgcgggtcttgcgaaggaacttttccttgaaaccctctggattgctgtaaacagtggggctaagcccctcaaagatggggggcttcgatgattcaaagggggcctccggagtcacaaagccgagagtcgccatgcctaggccacagctgcaggagaaaatcctttgtttttttttttttttgagaaggagtcttgctctgtagcccaggctggagtgcagtggtgcaaccttggctcactgaaacctctgcctccctggtcccagttaaagcaattctcctgcttcagccttccaagtagctgggattacaggaacatgccaccatgccaggctaattttcatatttgtatttttagtagagacggggtttcaccatattggccaggctggtctcgaactcctgacctcatgatctgcctgccttagcctgccaaagtgctgggattacaggtgtgagccaccatgcccagcctacatgttttatataatgttatttgatataacaacttggaaaggacaaaattatagaaatggagaatagattagtggctgcaggggttaggaatggggaggtggtgggaaggaggtatatgtttattaaagggtaatgacagggaggcttatggtgatggaactcttcgtatgttgactatggtgacagataggaaaacctacacgcgtgacaaaactgcacagaactaaatacacacaaatgaagtaaaagtggggaagtctaaatcagattggtggactgtatcaatgttaacattctggctgtgatattacacaatagttttggaagatgttaccatgggataactgtagaaagggtatatgtgatctgtctattatttcttatgactgcaggtgaatctacaattatctcataagaaaaagtaagaagaggccaggggtggtggctcacacctataatcccagcactttgggaggccgaggcaagcagatcacttgaggccaggagtttgagaccagcctgggcaacatggtgaaagcccatctctactaaaaatacaaaaattagccgggcatggtggcacactactcaggagctacacaagaggctgaggcaggagaatcgcttgaaccccggaggcggaggttgcagtgagctgagatcacaccactgccctccagcctgggtgggcaacaacagcaagactgcaagggaataatgttctgtttgggaaagagactgcatgtaaatagggggtctggtaggtgggcatggtggctaacacctataatcccagcaccttggaaagctgaggcaagaggatcacttgaacctaggagttcaagaccagcctgggcaatatagcgagattctgtatctataaaaaatgaaaaaattagccaggcatggtaatgcatgcctgtgatctcaactactcaagaggctgaggcaagaggatcaattgagcatccagaagttgaggctgcagtgagccatgatcatgccactgcactccagcctgggcaacagggcaagactgtatctctaaaaattaaaaaaaaataaaataataaatagaacatataaaagtaaataaaaattaaaaatagggatctggagctggtagggaagaaacagagctgtatgggagaaaagaatacttttccttgttgatatatggtctgtgtcccctttttctcctcttattttcttttgcattcttgctctgattgacttctttctcaagtgcctcttctctctgactttccctgtgtcattattttcctcaactcattattttccctctttgctttgctaaaagactctatccctgcatcttattcagagcacactgactgcactggacaggagttacaagagggaagaggtactcatagaatcctggatttctaaaacacttaagctacaaaggttggtgaatatcagagtccaatagtcacatattacacagaggaaaactgaagtgctgagaaaggaaataacttgtgtcactcacagagggaatttttggtaaagttggaatataagcctgggatccactagaacagcttccctaattttcttttcttttttttttagacaggttctcactctgtcacccaggctggagtttggtggcatgatcaaaactcactgtggtcttgacgtcctgggctcaagtgatcctcctgccttagcctcccaagtagctaggaatgcaggagtgtgccaccatgcctggctaatttttttgtattttaagtttgtagagatggggtctggatatattgcccatgctggtctcaaactcctggacacaagtgatcctcctaccttgtgctcccaaagtgctggaattagaggcgtgagccactacgcctagccctagtttctataattttcaacagacggagctcactagttggagaaaaagagattcctgggggcagccaattaaaacatagagaaattagagcaacatggtgagagaaataatctgatcaggtgcagtggttcgcgcctgtaatcccaacactttgggaggtcaaggcaggaggatcacttaagccttggagtttgagaccagcctgggcaatatggcaaaaccccatctctacaaaaaataaaaaattagctgagcatggtggcgcatgcctgtagtcccagctactcaggagtctgaggtaggaggatcgtttgagcctaggaattcgaggctacaatgagccatgattgtgccactgcatttcagcctgggtgacagagcaagagactttgtctcaaaaatagaaaagaaaagaaagaaaaagaaaaggaaggaaggaaggagggaaaagaaaaaagaaaaaaaaaagaaggaaagaaagagggcagccaggcgtagtggctcacgcctgtaatcctaggactttcgaggtgggcagatcacctaaaatcaggagtttgagagcagcctcgttaacatggtgaaacctcatctttactaaaaatacaaaaaattagccgggcatggtggcacactcctgtagccccagctactagggaggctgaggcaggagaatcgcttgaaccaaggaggcagaggttgcagtgagctgagattctgccattgcactccagcctgggcaacaagcacaaaactgtgtctcaaaaaaaaaaaaaagagagagagagaaagaaagaagaaaaagatgcagagaggggaagaggaaagaaggaagggaaggaaggaaggaaggatatagttattaagtagttatgagccagaattataaactagccagatggttttgtgataggatttgggtagaatgaaaatctcaagaggttaaattcctaagaggcaactcttctctcttactaactatggattattttaaatgcaccagatacccctcctcaagatgtaatattataccataaatgttatggggagaaactgcccaaatgaacagaccagcgctcacactgagaacaggaatagggagtagcctattttgagcctacctttttaaaaaacacttgcattttgggaaaatataaaaaaaaatgtccaacagggttgtcctgttggtaccaaaaaccttcagaaatttcagagtataggatgttggtaagaagcaccaaagcagaaagtacctctttctgcatgcgagaaaccatcatttatctgagagtgatgttccctaacacaagaaagggtctctgttaagcaagtgaggggtggaaggagctgttgccagagcccgccagaagcatcctggtaaccaactgctggtccaaacatttcctacttacatggaacagtggaaagtgccaacagagttctcccgacgaatgtcttcatattcctcatagattccctgcttttgcctgggcaaaatagtccatcaaccaaagtttaggttttctgatcttcttcccattcttacccagctggtggagtctacagcctatttcaggtttgacctcagtagctagaggaaaagtggttaaacaaaataaagaagttagaagctgatttacctttaaaaataacaaacttaagttcttgtctacagtaagttttatggatcaaaaactattctgacttcttatctcaacagatatcctacacatatctcacatcagcatatatatatgccttttagaaaattctgttattaaaactcgaaggaaaaatgagatcatgaataaactgaacatttttaaaaaattatctttcataacttttcaatctaatatctgtgtattataatcatttattgtttcatgtactaattcatctatgtatttaccaatcaataaatataatctgatatgcactatgataaatgaggtcaaaaaaaaaggagataccctgatccacacaggatataaagatgaagggctgggtgcgttggctcacgcctgtaattccagcactttgggaggctgaggtgggcagaccacctgagctcaggagttcaagaccagccaggcaaacatggcaaaaacctgtctctactaaaaatacaaaaaattagctggccgtggtggcagatgcctgtaattccagctactcaggaggctgagcctgaggcacgagaattgcctgaactcaggtggtggaggttgcagtgagatcgtgcactccagcctgggtgacagagtgaaattctgtctcaaaaaaaaacaaaagtgctgtattgaggactgagacctgagatagtgagagacagggatgtacaacttgagtcatactgtggactgacaggatgggaatagctaagggactgtctgaggtggggatgcctgtctggttcacttgttactgccttgtttatgtgacttagatagtacttagcttccgctgttgatactcagtgggagatacacctaaaccacacagacagcattattctgaaaaggagaagttgccagggagtgtggaccagtagtctccgtggccctgtactctccaagcagaagtgtagacttcttcttccctgtgactagccttcaggtgtaatttccagtacatagttccttataaattctatagctcaggagaataaataagaggctccttttccagaaaatccagtattggttttcctcctttggaggcgtagagtcagaactctcatggcatggcaggatccatggaggtggccacatctcccttttttcagtgagtattagatcccacaagacaaccgcacagctaaacataattaaaacttaggttttatgatatttgttcctttcctaaaaccttcagtgactccttattatccatagggaacatataagctaaataaatgtgaacttttttctccaagcaaaacattctccccagtgaatagaaaatcttgttttcctgtgttaccttgaaccaaaattttttttttttttttttttttgaggcaaagtcttgctctgtcgcccaggctggagtgcagtggtggcgcgatctcatctcactgcaacctccacctcccgggttcaagtgattctcctgcctcagcctcccgagtagctgggattacaggcgcctgccaccacaccttgctaatttttgtatttttagtagacatgaggttttgccaggttggccaggctggtctcaaactccggacctgaagggatccatctgcctaccttggcctctcaaagtgctgggattacaggcatgagccaccgcacttggactcctttaaaattattattattattgagacagagtttcgtgctgttgcccaggcaggagtgtggcactaccttgattatagacgcaagtcactgggccttgggattatagacgcgagtcactgggcccagctttctttccagttttaaagtattatttttaattatccaaactaaatgtgtagtaaatactcttcttataaatctttgttttcttgattgcttccttagcatataatttcagaaatagaactgatcaaagggtatgcacatttttaaggatttataatgccagatgccttccaaaagatgttaacaacttattgaactgacagtatataagggtgctatagagtaatttatttatttgaaaaacaaatctttattgtgtagaaatatgtattttaaaaatcccccagaaaagatgctcttctctcatttccccatcctcttccttttcttccacacctctgatatgaaggacattattataccttattaaaacttcatccacactaggcatggtggctcatgcctgtaatcctggcattttgggaggccaaggcaggcagatcacttgaggtcaggagtttgagaccagcctggccaacatggtgaaatcctgtctctactaaaaatacaacaattagccaggtgtggtggctgacgcttgtaatcccagctacttgggaggccaaggcacgagaatcacttgaacctggaggttgcagtgagctgagatcgcaccactgcactccagcctgggtgatagagcgagactctgtctaaaaataagataaaataaaataaaatgaaaacttcatccagatgtctagacaacactttaactatgtattcttctgtatttgcaagttacatgttcatatagccatctacagataccagttagcctttgtaatccattccccacttaagtttcaccatctactggcttttctgttaatcccttgaggaaaggtttggaattgaggagtaaatcctttataaggagaatgctgcagtctattcgctattcaccgctgaccaagctgccacctggccctcctgactgcagcaggcacccccagacagtcatgtaaatggactaggcctgagtctgtagttctttgctctgaaaaaggagacgtaatggcttctactttttatcatttggtggaaataatagaggagtttttctagaatgttttttgatctggtggttaaagggaacttggacatttagtccctgaaataaattgttgcatctttgaaggaaaagatgaaagtagtttcttacactttagtgaagaagcctttggaaaattttgttctggatgttgtatattctctgtagaggagtgttggggattccccacatcagcagaactaaagggtaactgaagagaacagggagtgacatgtcagattgagaatcagtcttttgaaagtggcaaaaagaatatgtgttaaaagaaaaaatagggtagaagataaaaagaatagggcagaagatattagcttcaattcctccttttttttttttttttttgatcctttggaatgatttcttcctagactgccagtgttgcgtagtaaccccgcccatgaagaggactggaatactgaaaaactgcatgaaactaagcgctgtgggttgggcggggtggctcacgcctgtaattccacactttgggaggccaagttggctggattgcttgagctcaggagcttgagaccagcctaggtaacatgatgaaaccccatctttacaaaagatacaaaaattagctgggtgtggtggcatgaagctgtagtcccagctactcaggaggctgaggtgggaggatcacttgagcctgggaggtagaggctgcagtgagccgtgattgtcccactgcacttccgcctgggcaacagagcgagatcctgtcccaaaaacaaaaaaactaagcactgtggattagaaattaataatttttcatctttatatctttttttttttttttgagacagtcttgctctgtctcccaggctggagtgcagtggcacgatctcggctcacttaggcaaggtgtttaattaatctctgaaaagtggagaatttagcaccaggcatggtgactggtgcctgtaatcctagctacttgagaggatgaggtggaagtgttaaaggtggagggtgtccaggttcttggtgtcttgaaaaaagaattggacaaaatgcacaaacaaagcaaggaagggacaaggaatttactgaacatgaaagtacactccagtgtgggagcgggcctgagcttagaagttcagtggctccgttacagaattttggggagtttaaataaccccagaggattccatggttacttcgggtatgccttatgtaaatagagaagatgaagtaaagttacaaagacatttatggcctatgccctatggacagaatattacctgttatagctgaagtgtgaattggccttatgttccctacctccagaccctattttcctgcctcaggaggattacttgagcctaggagttcaagtccagtctggacatcaatagtgagacccctgcctctgaaaaaaaatttttttgagacagagttttgctcttgttgcccaggctggagtgcaatgggatgatctcagctcactgtaacttccacctcctggattcaagcaattctcctgcctcagcttccctagtagctgggattacaggagccggccaccacgcccggataattttttgtatttttagtagagacagggttacaccatgttggccaggctggtcttgaactcctgacctcaggtgatctgcccacctcagcctcacaaagtcctgggattacaggcgtgagccaccgagcccagcaaatttttgttttttagacggagtctccctctatcgcccaggctggagcacagaaatgcgatctcggctcactgcaacctctgccgcttgggttcaagtgattctcctgactcagcctcccgagtagctgcgattacaggcgggcaccaccatgcccgactaattttttgtatttttagtagagacggggtttcaccatgctggccaagctggaaaattttatttttaataaatgaaaggcagagtatttatctgaaaaaagtgggagaccaacagtctcatgggattgttataaagattaaaagagagagtgttactgaaatacttagaagagctgttattctattgctgtcctttccccttgtatttggatagattaccgtacttgtttcttctatgtaactctaattgtcagtggggttctccctctcttagaggcctggagaaacttgtcttaaatgctttcccagttaatgaattgggagaggcagattttatgtctaaattacaagggcgagacttaaaagtatgaattggggctaatgtcagtgctcaggtgcagggatcctccgttttgttcatcacacagctcccggcactttaataaatgaggctcaaagaaacgacgggcttaggtcatgcagtagtcaaattcagaactcatgtttgattccaaagcccacacgttttcctagtttagaaacactaaacatttaattcaccgcaccgggggccagacaggtaatggagaacgccttaagtatgttaggaagggaagttatctacagtcgcagccgctattcagatctatttcactgccttgcagaaaacgccgactgtcgtctctttatcccatggccgatttcttgtgaaatctcctaacttttaaatatttccaatcaaaagactgccgttcaaatgcagcccaccaggagcatgtttgcaaactctggagtaaacaagagtgggaagctgataaggtgagtacctcagttcgatagtgacagccaagaaacggggagttttgtacctaaggcgagaaagaaattctccgccgaaatctcccggaagaaggactgaattaaatgcagattagagtcagggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctccacagccctacgacttccgcttgcctcgtcgtctgggaaaccgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgcactccagcatgagcgacagagacagactccttctcaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagacaccccatcaaaactgagtaaaactagcccagtgtgggacgcagaaattctagtatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttcctttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcatggtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgcgggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcacctgggttatgtaaatttttcagtggcttttaaacctcatataatgtttgtttgttggtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgtctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggccagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcacctttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcctcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttacgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcagaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttctttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataggcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttatcagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagtttttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcgtgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagagcatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaattcgtttttgtttttttttttaattctcatgaaacaagatgtccaggtaagtagttgctggcattgatttggtggtcctaggatgtcaagactgagagtttttcctcatggttacaagaagactgctgcatccagcatcatatctgcattctagggaggcagaaagagaaagcaacaaggagaaaaggacagagcctatactgggaaagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcgggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcattttattatatgttcaggacatgtattcagtcttatcttccatatcatcatttttgtttttagctatttgtattctgttatataccctatccatccaatattttttatttcatttccttttattgtatttttaatttccaaaaatcttgtcttttcttcaatgtctctgattcttgaagttcttttctgcttctcagaattatctttttcttcctctctgcattttggttcttctattttatgctgttggtatttttcaagtatttggtgattctcagagagacattcatatctgtgagtgaagaactagatttattagtacagagaattagcatggatttcctttgcagttcttacggggcactattatttttgaagtgtgttcaatttgttagtcgcttttcttctgtacatcggaagattgagttgagtctttatgccatggagtatgttatagctaacagccagagtgaaactacagatgaagaaaaattcatgtacttttcattcagtcggtttttcaaaaaatgagtatgtctgctatatgccaagcactgatctatgccctggagatgcaaagatggactgttggattataagatactcaactagaataggaaatgaaggaagaagagcaaggtttggaagaaggtgatggtaagaaatcagagttaaatcctgtctttcagaggattttggatatgataagttttaggttctgaggggatatctaaattgagatgtgtccagtaggattggatatagaaatctgaaactcaagtgttttggagtagagatgtgaattctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcagaagaagagaacccatagagggagatagggaagaggtaaagcaggagagctcagggtcacagggggaatggaacgtatttcttaatctatccagttggttgaaagagctcatttggtattactgactcacttgggataaccatcccattgttactagtagatgtgatcattcacaaaacagccattctttttttttttttttgttgagacagagtctcattctgtcacctaggctagagtgcagtggctcaatcttggctcactgcaacctctgcctcctgggttcaagcgattctcctcccccagcctcctgagtagctgggatttacaggcacccgccaccatgcccagctaatttttgtatttttagtagagatgaggtttcaccatgttggtcaggctggtctcgagctcctgacgttgtgatccgcccaccttggcctcccaaagtgctgagactacaggtgtgagccaccaccttttttttttttaactttaaaatttttctttaaaattttccccttcatggcatttttattttctttttagaatattttaatgattttgaattttacttttattaatagcccttacctaccctacatatttcataagtacctgtagaaaaccttatagtagctggagcatggtggctcatacctgtaataccagcactttaaaaggatgctgagtggggaggatcacttgagcccaggagtctgagaccagcctgggcaacatagagacccagtttctaggaaaaaaaaataaaaattagtggtcgtgtgcacctgtagtcctagctattctagaggctgaggtaggaggatcacgttagcccaggaggttgaggctgcagtgatgcggtgaactgtgattgtgtcactgcacttcagcatggaaagcagagcaagaccctgtctcaaaaaaaaaaaaaaaaaagaaacaaccttgtagccctactttcttggactcatcagggtattccacagtcttgctgcaacaggggaatagtaattcctcctgccattatcttagttgacttttggaacagttctgttaagtagggagaatttcccccattgacaagtgaggaagctaaggctttggaagatggaagttgctacagtgaggtagttgctgagccagaactggaattcagacctgtgatctaggatgatctaagattcctcgtcttaagactgtgatcttttccactgtaccaactgcctttgcaggatgtctgctgggttcccttacctcctgaaagataggatttgactctgatttgttctgttgccctttccaaatttcttttgcagttagtttgttaaaggtatattgctgccttctcaactatctatgtcaaagattttaaaaggtcagaggttagccttcaggacatctatttacttacctaccttaacaattcctactgtagagcaggacatttaaaggacaagaaaggctttatttctgccttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaataaatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatgtagaactaaaaaagaaaaaaaaaatcccaatactctctgtcttaagttaggtaatctactcaacctctctgagcttcaatttccttatctgtaaaattggaaagattataactatgttgcaggtttgctgaaaattaaagtaacatatatgaaaacatctggcataaagcctgatgttagtaggtgctcaaccaatggttgctgttttgttgtttttactatttttggagacttggaaaacattaaatcagttgttatctctgagcctgggggtccatgtttcctcagacagggacacatctccactactaatagggtagttcttactatgtttcccaagagcattttccttacccttgctttctccttttccaaagctaccttaaataaagggaggtttattataaaggaatttgagagtccataaaacagtatcaagagatgcaggttggtcttttagtgaagcagaactggaacgcttcagcatccaaggtagctactctgccttttctgcttcatcttttctttctgtagatcaaaggttggcaaactttttttgtaaagggccagttaataaatattttaatttgtatagcttcatacagactctgttgcaacgacttaactctgcagttctaatgcaaaagagccatacaaaaacaatagttgtgtctgtgttccaatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagtttttagggtcattgaaaataaattttaaattttaagtggatctgatttctgagttttcagttttaattttatagttattttccatgatgagaaattatatttcactgtgattaagctatagactcctatatcagagaagacaagttgagcttacctcaaatttggtactcaggtaagaaaaagtatatatcataattgaggagtagacaaaattactgagagctctaaaacttagtgatgagagcgttgggtagtttccttcatagagctcacagttagtgattgtgaagttttattctcctttctccgatgccaccaggactgagaatctgaattggttagtacccatttgacaatgtttagtttgtgtcaatttgcagactggtgtaactagtatcccacactggtgtgaaaaaaaatatgcacattagcagttggggtgtaaaagtaacttttctcctgagataacaatatatatacataaaatacatttagtgggccccttaggttttgtagatggatctatagttttatatacttggttaggagatttttctcttcagagacaatttcaaacaggcacatttctattcacaggattattctgagtcaggggaaaagaaggatttgtctttggttggatctgtgctgagaagaaatatatttagattttactgtacagctaacaggctaggcaaatacaatacctggcatttatataaatgcttgttgaatctgtgaatgactaaacaaagcccttttgtttactaggagaaggtaagctcctccagagcaaggagttggttttataaactcaaatatatttagcatctagaacagcaagcagttgggtgaataaatgagaacaatctatttattcatttatcatcacattgatggggaaacctggcccaccatagggaaggttgtgcacttggtcagtgttacagctgggatttagtttagtgtagtactctacactgtactatgatggcccttttgacttatgaagtatgagtcataggtgtgaatatcaggcagaaaacattcagaaagattaatcgtcttgtataaattcttccaagtggctccagaagcagatatcccatgttgccagctgtcttttcaacaaggacagttttggtatgttttggtctttgggtagtgggggctgtttgctgaaatgtgatgttcctatgtcaatacagcagaaagtgtctttacattagccatataaaggtatagttcgttcagtggtagtgatttggttttctttattttgttaaacttgtcaggcacaagaccagttgcacaatgccctgaatcttaataggcacgatctgacttatataatgctggggaagatccacttgctggagggagacttggacaaggccattgaagtctacaagaaagcagtggagtaagtgtatctgtttcctttaaaacagtgagaaactaaaaaaattgagtggatatgtgaactcccaagcctaaaagagtgaatatgtttgattaattacttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatatatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagccactgcacctggccttggtaataagttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagtaaaaaacaaaacaaaacaaaacaaaacatttggccttattagcatgagaccagtatcttttttcccccttccccattttcccttccccttccccgttttccccttccctttccccgttttcccttcccccttttctcttccccctttccctttcccccttcccccttcccccttcctcttccccttcctccttccctcttcccccatcccccttcccccatccccctttccccatccccctttccccatccccctttccccatccccctttccccatccccctttccccatccccctttccccatccccctttccccatcccccttccccctttccccttccccctttccccttcctcctttcccttccccctttccccttttcccatctcccttcccctttcccctccctctctcccttccttcctttttctctcttttctttccatcctttccctccctcccattcccatctttctttgtttctttcttttcttcctttcttccttcctttctttccttcctttcatttatttcaacagtctcgctctgtcgcccaggggtgagtgcagtggcgcgatctcgcctcactgcaacctctgcctcctgggttcaagcgattctcatgcctcagcctcctgagtagctgggactgcacgagcacgccaccacccctggctaatgtttgtatttttagcagagacagggtttcaccatgttggtcaggctggtctcgaattcctggcctcaagtgatctgcttgccttggtctcccatagtgctgggattgcaggcgtgaaccactgcgcccagccttgtgttgttacttttaaatgggatagctgtagcaaaatgccttgtctcatttgtttggtcccttaatagaatgtctggtctgtggttcaaggcttattattcctaataattagattctgaactaaacttagatttctattaatttgttaatcatctttgtcttctaccatggtagtaaattttctggttatatcagtcacagcactgctttctgaattttcttcaaccatattttgtgtctaaaacagaaaaatcccttggtttgttaagctacagaacagacttttgtcatcaagaggctgtatatttgggcaagtagtaaggagccatgtaacatgttcagtgcctctgtggtgctaggtagtagccctgatccctgacccctgccttctagaggttagctctttgagaatagcatacataaatcccaaggggaacattcttccagtaactgatcaaggactttggtcactaaatttcctaagggagaaatgtggacagctaaaatctgaagccttactgagaagatagagaccattgttcatgacctacagctttgaagagagtagtcatgttgtagtggggaagccaatattgctagaattacagaagttacctggctttggggagggaagtgatcaaagtggatgtttattatggcagaaagtgaaaggcggattcccagttgaattgagaaagctctgtttggtcagctcaggcctcccctggctggggctttgcatcttctggttcaggtcttcctataggtaaccagtgccctatatcattccttagaagcagaagacattgttcatagccctttggtgttttactgttgaaactgtctgatgatcctatggtcagatcatctcaactcagtgttgccttggttttgtgacaaagacaaatactagtgagggattgagcaggcaatccctgatgtgagtattttacttacatcagtgtttactcccaaaggtcagtagcaccttctttcctaggattggtatgtatcttccttcttttgtttagtttggctacttggtatagctctttgtttaagtggagagaacagcattaggggccttgggatcctaaattacatagaaaattatgctgcctggcattgtgagcacaatgaggatagaaaaaaaattccacaagagaggactggtgaaactgtgtgtgttctaggctgacttggtttataaagcattgttctttaattttatcagtgtgaccaagacagtcatgcaaaacattctataggttctttcttaggacttttaccctaagaaaggaatctgaattctaagcctcatttttcttgctgagcagttctccttatcaccagggttgagatgacctacttttgatggcaattcccaaattgccttcaggtatttccacggggaggaagaggctcagtggggtctgtcaagtattgcacgagggcatattactgtgcatgtgtcttcgtgtttctcatctacatcttgtttccctctgagcatctctatgttgcaggttctcaccagaaaatacagagcttcttacaactttaggattactctacttacaggtaatgaaaactctgtactcattcatgcactgatgttagaaatggttttgggtttgtgtgtatggtggttttcctgcattctgatatttattttattaaaggtcatataaagttcatgaactacactctctctattcgatactctttgctaaaggaattaattttctgcatttaaattggaagcaattctattttagcctagtgcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcagaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatccaaggggcttttccctcttccccaatatacacatttgccaagttccttggtcagctgattctgcctccagccctgcctctgtggtggcctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgctttttttttttttttttttttttttaaagtcaagagaactcaaaaaagccagagcatttctgttctgggtgaggttggccagactgtttttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtgatccacccaccttagcctcccaaagtgctgggattataggcattagccaccacgcctggtctggccagactcttttaactgccgtctccttgctgatgtaaattgtcttgtttgctttttttccaagctcggcatttaccagaaggcatttgaacatcttggcaatgcactgacttatgaccctaccaactacaaggtattacaggctgtgaaggctctggccttcatatagacggtcccactgctcctagaggtgatctgaccctggaaagcaaaggaatagcttcttaaatttggatacctgagaaatagaaaaaatataaataaaaggtggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagacccccatttctacaaaaaaaattatccaggcatggtggcacacacctgtagtcctagccactcggaaggtggaagagggaagatcacttgagcccaggagtttgagtctacagtgggctatgatggcaccactatactccagcctgggtgacagagaccctgtctctaaaaagaaacaataattatgttgaaatgacttctagagtcctaatgatttgatactacaactttttttctagatgtgactttgggaatgagaaggaatagcatcaaatggatgaacatcattgaggagatgcagcaagacaagctgtttattaaaggatacaaactgaattctgatttaggaagtaacattagactgtcagctcccaccttgatacctttccttagagaaatgaaagggctgggctgatgaagcctaaagctgactcgccctctgttttacggtagaaagaaatttaccttaagtagccacgtacaggtgtatttcaggtatctagaacacttggtataccaaataggggctgcagagaacagattaaaggaagtttttacttaaagggctctggtattcattctgaaatactgactttcctggctagaagtaggaaacagatgggtaaagcaagtaacattttatctttttttttttttttttttttttttttttttgtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttgtatttctacatgtggttattgggtctgtttagcttgcccttctcattgagtgccccttctctctcataggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcaggtaagaaacatttatgtggaaaactctctctgccatctgtaatgagggaaaaatggattagaatcatagaagatcagtggctgtctcataggagccattcccttagagatcctgtaggaatctggattactgtcctggagcttgaagaaatagaaaaagatgacaaaggaacttggttgtttctaacttgggggagtttgactcagagaccaacaggttaaataaagatcatccctagttcaccttttaccagttttttcctcttgccttgacaattcatttatgtatatattgagtccaactaagttccagacagcaagtgttaagagcttgggttttaggtagggtcctgcctctactacttattatatgtacctagggctgatgtgaggattgcatgattaagctctcaattaataatactggttttgttgaaatactgatttttgaaaactgttggttttactgtggttatataattggtctattattatcaatattgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgtcttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcaatcaggaggtagagggagcaaggggtaaatgtgggcacaattctttattgtagttttcatgggtagaaatgccctccccggggcaagaccgggaaagcaggttaaccaggttggggattggccagtttgaataatttcagtgggctctgggctatagggctgtctctaggtgtctggtacctgaccctcgggtgactaggactagggaatattggcccagtgtcagggcccagtaaaggaggcagttaagaatatgaacactgggttggtcggtctgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacgtgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttacactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatatagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtgggcttgggttgctgatagctatgggctagctggaatatcagatgggactctgggctgtttaattcaagataaaacttgactcttccaggatttactccgctggcatcttctagacagcagggtagagatccctttttcaaccctggcctaggtagtctctgttgagggctgagatgccagatttggtcccaataccagctttgcttgttaggccattaactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatcaagcccagatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtacaagccacatgtgtctgtcagcagagattatagctttcagtgaggttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatgatcacggtcttcccttacctgtgtctaagcctattttgaaattggaggaggaacctcaaggccaagttcctgcttggtacaggcatggcctctgcagcaaccctgatgcatgataagccagcaatttgcttactgagggccagtccccattttgcactgaaagtgccctttaatcaccataatttaaagatagatagattagatagatgatagatagaaaactgacctactaccaaaccggttggagttccttattttattacagggtctgttttgacattgaagaagcagctaactgagcaggacccccttcatttcttgtatctcaaaaagtatcagaagtgatgcctttgtcattcagctggtggtatgtggcaaacgtggatttgtaccctgaacaattgagaacacttctacttcagcatggagtctagtatattagaatgaaatggtctagttactttctgaaactggaaaagtcttagtgaaaaaagaggaagagagatttaggagctaatatcaacaggaattggggattgattggatgtggcaggttaataattgggtacccatttcagggcttagataaccagggagagtaaaggaatattggactagggttgagggttggttgtggaatctagttttagatgtttaagatatctaatgatgatatccatcagatacctgaatagctagatttcaggaatgaaacctggtttgaagataaagattcaggagtaggccagatacggtggctcacacgtgtaatcccagcactttgggaggccaaagccagaggatcacttgaacccaggagttggagactggcctgggcaagatggctcagacctcatgtctacaaaaaattaaaaagccaggcgcagttgtgcgcacctatagtttcagctatttgggagactgaggcaagaggatcacttgagcctaggaatttgaggtggcagtaagctatgatcatgccactgcactccagcctgggaaacaaagcaagaccccatctcaaaaaaaaattttttaagattcaggagtaatttagatttgaggaatcatcaaaaccatagttttgaaaggagtcatccacggaaagctaggaataagacgacaggcaaccaaatgaaagaaaataagtatttagagggagaagcagaagagcccacaaaaaagcatatgatacaagaaaaaacccaggagagtggtattatgggaagccaacgaagaaaggtttgggaagagaatggtcagcctcattgaacacttccaacagagaggtactgttatccccattttatagaagagaaagcttaggttaggagagacaaaacaaattttcaaaggtaagtggcaggaccaggattttaatccaggtctggatgcagagctcttgctcttaaccatcaatcatcaagcagtgatgtatctttgatgaagcagtggtggcaacagaaacttaaggacttgaagactgaatgagtagatattggactacttttatttcagaaagctttgatgtagagggaagaggttttcagaggacagaactgtattcattactctgatatgagaaacttctaatatttggggagagaagggtaaaaaggtagtcttttttaagtatagcatggtggaaacagagaatgcaagagtagagtttttgagtttttccacatttgggggcaagatggtgctttgcttccagggatagcagtaaagaagcaatgctttccacattaatttgacttagattttcttttaaaaataaactctactagggtgtgcagggtcagtcttttgggcatgtgaatttgcaatttttcttttactctggtgagataggagctattctaacttctagtatgggggttggttgctcatgtcatcagaatttgtaacagaattaggaaaatgaaaccaagaacataatcacagctacggatgtggttttagaaaactgaaagagagaggcaggaaagtagaagtatgaactagcaatgagaaaaaagtatccttcttgctgaataatattgggcaaaactgtgcattccaaagacagtaaaccactttggagtgtgtcactacaatgatttttgttttcaaggaaaactcattattgtctgataatggcttagtagttcatgtcggaccaatccttccataaataacaaatgtaaacaagtggtaaatataaaatactctctcggtttaactttaaaaaaatacatatgattgttcaaagaaaaaatatcacagtgtatgtgaggctgaacatacataaataacatgacaactataaagcatatatggttgcaaggttttaatattttatgtagtgggacacaaaattaatcctaaatagtttgtgaaaagctgaacatggtcctagccagagcaatcagacaagagaaagaaagggcatccagatcagtaaagaagaagtaaaactgtcgctgtttgctgatgacatgatcgtatacctagaaaaccttaaagactcatccaaaaagctcctagaactggtaaatcaattcagcaaagtttcaggatacaaaagtaaagtaaagtacataaatcagtagccctgctatatgccaacagcaaccaagctgagaaatcaagaacccaaccccttttacaatagctgcaaaaaaacaaaaaacaaacaaaaaaacaacttaggaatatactgaaccaaggaagtaaaagacctctacaaggaaaactacaaaacatcactgaaagaaatcatagatgacgcaaacaaatggaaatacatcccatgctcatgtatgggtagaatcgatattgtgaaaatgaccatactgccaaaagcaatctagaggttcagtgcaattcccatcaaaataccaaaatcattcttcacagaattagaaaaaacaatcctaaaattcatatgaaaccaaaaaagggcccgcatagccaaagcaagactaagtaaaaagaacaaatctgcaaagccaaagtgagactaagtaaaaagaacaaatctggaggcatcacattatctgacttcgaactatactacaaggccatagtcaccagaagagtgtggtactggtataaaatcaggcatatagaccaatggaacagaatagagaacccataaataaaaccaaatacttacagtcaactgatcttcggcaagcaaacaaaaaagtggggaaaggacaccctattcaacagatggtgctgggttaattggcaagccacaaatagaagaatgaaactggatcctcatctctcatcttatacaaaaatcaactcaagatggatcaaacacttaaatctaagacctgaaaccataaaattctagaagataacattgaaaaaaatccttctcaacattggcctaggcaaagacttcatgactaaagaacccaaaagcaaacgaaacgaaaacaaagataaataaatgggacttaattaaactaaaaagcttctgcacaacaaaataaataatcagcagactaaacagacaacccgcagagtaggagaaaatttctgcaatctatacacctgatgaaggactaatatccagaatctacaaggaactcagatcagcaaaaaaaaaaaaaaaaaatcccatcaaaaagtgggctaaggacatgaacagacaattctcaaaagatatacaaatggccaagaaatgtgaaaaaatgctcaacattgctaaagatcagggaaatgcaaatcataaccacaatgtgataccaccttactgccacaagaatggccatagtcaaaaaatcaaaatatagatgttggcatggatgtggtgaaaaggaaacacttttacactgttggtgggaaagtaaactagtataaccactatggaaaactgtggagattccttaactaaaagtagttctaccacctgattcagcaataccacccctggatatcttacccagaggaaaataaatcattatatgaaaaagatacttgcacatgcttgtttatagcagcacagtttgcaattgcaaaaatatggaaccagcccaagtgcccatcaactgatgagtgagtaaagaaattgtggctcatgcctgcagtcccagcactttgggaggccaaggcaggcagatcacttgaggccaggagtttgagaccaccctggctaacatggtgaaaccctatctctattaaaaatacgaaaattagccaggtgtggtggcgcacgcctgtagtcccagcaagtcaggaggctgagggagcaggattgcttgagcccaggagtttgaggctgcagtgagctatgatggcaccactgcactccagcctgaacaacagagggagaccttgtctcttacacacacacagcaactcataaatcaagggaaaaaaagaaaaaaatactttgaactaaatgataatgaaaacaaaacgtataggattcagccaaaagcagtgcttagagggaaacttagaattgtaaatgcttctatcagaagaaaggagaaaatcagtgataacaggtttccaccttaagctagaaaaagcagagaaaaataaacccaaagtaagtagaaggaacaaacaaacaagtattaaagaaaaatttgagaagccccaaattctatggaaaaaaaatttatgataaatccctacaaagagctgagtgcggtgggtagctcatgcctgtaatcccagcacttagggagggggagtattgcttgagcccaggagttcaagaccagcctgggtaacatagtgagacctacgtctctccaaaataatttaaaaaatacagaataagttagcagggcacggtgtcacatacctgtggtcccagctacttgggaggttgaagtgggaggattgcttgaaccctggagattgaggctgcagtgagccatgattgtgccactgcactccagcctgggcaatagaatgagaccctctctcctgaaaaagaaaaaaaaaaaaaaatccccagctaaactgatcaagaaaaagacaaattaccagtatcaggaatgaaagcgggtataatattacagattctgcagacatgaaaaagggaatgttatgaacagttttatggcaataaacctgacaaatgcaacagacaaaaatctttgaaaaatacaacatactgcctggcatagtggcacacgcctgtagtcccagctactcaagaggctgaggcaggagaaccgcttgaacccaggaggcggaggttgcagtgagccaagatcgtgccactgcactccagcctgggcgacagagcaagacttcgtctcaaaaaaaaaaaaaaaaaacagaaacaagatgaaatgtaaaatcttaagtcctactaaagaaacagaatttgtaaatcaaaagtaatccttgaaagcagactcctggctcagatgattatactggtaaattctgtcaaacatttatggggcaaaataaattcaacctcacaaaaatttgcagaaaataggagcgagaacttaacttgtttgtatcaggctagcaataaccctgatgtcaaaactggaccaaagacattacaaaacaacaaaactatagactattaccctgtatgaacataggtacaaaaatcctcaacagaatattagcaaatcaatccagcaatatataaaaaggtgaatatgtaaatcatgaccaagttggagttatcccagggaccctaagcttggttcattattgaaaaccaaagtactcacatgcattaacaaaagagaaaagtcatatgattttagtagatacagaaaaaaagcaatttttcttttgagacagtcttgctctgttgccccggccagagtgcagtggtgcaacctcagctcactgcaacctctgcctcctgggttcaagtgattctcccacctcagcatcccgagtagctgggactacaggtgtgagccaccaggcccagctaatttctgtattttttctgggggaggggagggggggctgtttcgccatgtttgccaggctggtctcgaattcctggcttcaagtgatccacctgccttggcctcccaaagtgctgggattacaggcatcagccaccacacctaataattttttttttttagataaggactcacggttgcccagcctggagtgcagtggttcaaacagctcactgcaccctcgaagtcctggactcaagtgttcctcctgcctcagactcccaagtagccgggatcacaggcatgcgccaccatgcccagctaattttgtttaagagatgggggtctcactttgttgctcaagctagaaaaaaataaatttttaaaaagccagtatagccaggcatggtggctcacccctgtattcccagtactttgaggggtggaggcagaagaatcacttgaagccaggagttcaaaaccagcccaggcaacatggtgagaccccatccctacaaaaaaaatttaaaagaaaaattagctgggcgtagtggcacatcttgtgatcctagttacttgagaggctgaggcaggaggctcacttgagcctgagaggttgaggctgcactgagccatgatctgtgatcatgtcactgcactccagcctggatgatggagtgagagcctgtcttaaaacacacaaacacaaaaaacccatcatgtttcttaaatgataaaggactgttacataaaatatacaaataacttcaaaaactctacattaagaatacaacctgaggccgggcgcgatggctcacgcctgcaatcccagcactttgggaggctaaggcgggcggatctcttgaggtcaggagttggagaccagcctggccaacgtggtgaaaccacgtctctactaaaaacacaaaaattagccaggcatgatgcctgtaatctcagctacttgggaggctgaggcagaagaattgctggaacccgggaggcagaggttgcagtgagtggagattgcaccattgcacatcagtctgggcaacagcgaaactgacttaaaagcaaaaaaaccaacctgactagaaaatggaccaaaacccctcacctcaccaaagatacacagatggcaaataaacatatttaaaaatgttccacatcatatatcatcagagaaatgcaaattaaaatgagataccactacatacctattagaatgcccaaatccagaacactgacaccaccagatgctggtgaggatattgagcaatggactgttcatttatcgatgttgggaatgcaaaatagtataaccactttggaagacagtttggcagcttcttacaaaactaaacatacttttaatgttagaactcagcaatcacactcctatttacccaaaggagttagaaatatatgtccacacaaaaacctgcacatggatgtttacagcagctttattcacagttgccaaaacctggaggcaaccaaaatgtccttcaataggtgaataaatgaataaactgtggtacatccagataaaagactactactcaattctaaaaagaaatgagctatgaaaagacatgtaggaaactgaagtgcgtattactatagaaaggaaccaatttgaaatggctgcatcccacatgattccaacaatatggccttctggaaaaggcaaaactataagacagcaaacggatcagtggttgccaggcattagtggggagggaaggatgaacagagcacagagggttgttagggcagtgaaattaccctgtgtgataccatagtggtggatgcatgttgttatattaatatatttgtccaggccaggtgtggtggctcatgcctgtaatcccagcactttgggaggctgaggtgggcagatcacctgaggtcaggagtttcagaccagccgggccaacctggcaaaaccccgtctctactaaaaatacaaaaattagccgggcatggtggcgcacacctgtaattccagttactcaggaggctgaggcaggagaatggcttgaacccaggaggtggaagttgcagtgagtcaagattgtgccactgtgctccagcctgggtgacagagtgagactctgtccaaagccacagaatgtacaagactgaagccaaaagtaaattatggactttgggtgataaagatgtgtccgtatatatacatcagttgtaacaaatgtgggagatgtttgctttacatgttcttgtgggagatgttgatagggagggaagaggctatgcatgtgttggggcagctggtatatggcaagtgtctgtatttcctcaatttcctatgaacctaaaacttcaatacccttctcagcccctgagaaagtaaaaacaaaacaaaatcataaaaattctcagcaaataaagaatagatgggaacatcttcaacctgatgaagggcatccatgagaaaaaaaatgcaatggatatcatatttagtgaaatattgactactttgcccctaagatcaggaccaaggcaaagatgtttgctcttaccacttctattcagccttatactggactagagttctggccagtgcaataaggcaagaaataaaaaggcataaagactagaaaggaagaaataaaactctttacagatgacatgattatgtggaagatcctaaggaatcctaaaaataaattattaaaataaaagtgactacacccaagtggatttggcagggtcacaagatacagtcaatgtacaaaaatcaattgtatttttatatacaaggaacaattttgaaaataaaaaaaatcacaaaagtgtcaaatactattgatacgaaatacttaggaatttaacagactacacgttaagacctctactctgaaaacggcaaaagcactggtgtgaaacagaaggccattatagaaatatatatcatgttcatgcattgtacgactaaatactgttaagataaaaattcttccgaaattcatctatagatcctatcataatcccagcaggttttggggtagaaattgacttgacaagctggctctaaaatgttatggaaacacaaaggaccaagaacatgtaaagcaatcatggaaaaaaaccaaaattggaagacttacactgccttacttcaagacttactataatagtgctcatgtagcactggcataaagatagacaaatagagcaataaaacagaagtgagtgcatacatagaccttacagttatacagtcatttgatttttgataaaggtaccaaagcaatgcaatgggaaaagtcttttcaaccaatgttactggaacgactggatagctgtatggaaaagcaatctaggggcaggggttggggagatgtacaacacggtgactctacttaatgtattattgaaaatttcctagtatataaaaatacaatacaaaagaatttaaagaagaaaaagttattgaaaattgccaacagaagatttcaagtgttctcaccacaaaaaactgagacaatgcataattagctcaatatagctatatacctacagctaatgtaaaggtaatatatacatatttcaaaacatgctgtacatgataaaaacttacacattttatatacaaagtgagactatatttgtgacatgggcatggtccaatatttctttgggcatagagaacattaagacattaagaaaaaggatatcaaaccacagacttggagaaagtacaaaacatatctgacaaaggacttgtatccaaacattttggatgcaactcttattactcaaaaaaacctaacaacccaaacaacatacacaaagcaaacaactcaactgggggagaaaaaggcaaaagatttggacacttcacaaagaaagatatatgaatagtcaataaagcacatgaaaaagtgctcatatgtcattagggaaatacaaattgaatccatgctgaaataccactgtatacctgtcaaaatgggtaaaattaaacattgacaactccagatggttgtggggaagaaaagcaaccacaactgtcatatgctgttttagggagtgtaaatggtccaaccattttagaaaaaaggcctttcacccagcaatttccctcctataggcctttacccaagagaaatgacagtacgtctacacaaacacttgttgacagcagctttattcataataattccaaagtggaatgctctgtactcacagtggagtactatctagctataaaaagcaaccaactacatgcaacatggattactctaaaaaatactatgctaaatggaagaagctctatacaaaggactaaatactgaatggctccatttttaagttgcattctgaaaacaggcaaaactgatttctggtggaaaataactggttgttctggggcttgaggtatgcggtggggatgacttggaagtggcatgaaggaactatctagggtgatggagacttttcatttttgctgctccttgcagatcaagactaactcagacaatgtgcttggggctgtccattctgaatcttttttttttttttttttttttgagacagagttggctgtgctgcccaggcagaagtgcatgatcttggctcactccaacctctgccccatgggctcaagcagttctcttgtctcagcctccccagtagctgggattacaggcacccaccaccacacccagctaatttttgtatttttagtagagaccgcgcctgaccgttacctggccaacatggtaaaaccccatctctacaaaaaatacaaaaattagccaggtctagtggcaggcacctgtaatcccagctactagggcggctgaggcaggagaatcgcttgaacctgggaggtggaatttacagtgagccgagactgagccactgcactccagcctgggtgacagagcgaaactctgtctcaaaaacaaaaaggccaggtgtggtggctcatgcctgtaatcccagcactttgggaggccgaggcggctggatcacctgaggtcaggagttcaagaccagtctgggtaacctggtgaaaccccatctctattaataatacaaaaaacttagctgggcgtggtggcaggtgcctgtaatcccagctactccggaggctgaggcagttgaatcacttgaacccaggaggtggaggttgcaatgagctgggattacaccattgtactccagcctgggcgacagagcgagactctgtctcaaaaacaaaaacacaaaaacaaatttaccaaatggcacacttaaaatttgtgcagtttcactatataaacattttcacctttaaaaaaaaaaagaccagaaaacaaaatgttaaattattacaagtagcttttcagtgatttaaaatagttctaaagagacccaagaaattgtctgttcagcttggttataactgacaattatttagctcttaagtatgtgccccatactgtgctaaatattccacatggcagtctcctgtaatcaacagccctatgaaggtaggtaccgccattaaccccattttacagataagcaaagtaaggctcagtaagggtaacttgtccaacatcattcaatactcaccacctcaaaaccttttgtacaatttggatttcttctcaaacttgccaggagagaatacaatgcaaactgtacctgcataagatgacggatttttggctgtactcttacttcttggtagtgctttgtatgctgcagcttttcttttccctgaaactaaaatcagtttcaaatgaaagccagagggagtgtaccaacacttttcaggaagactcacccttcaccaggcatcctttttaggccaatggattttcaaagatttcttcatataaaatcatatgtaaaatacctttgtaaaacaccaaagggttgagaaacctgaagcccccacctgttcagcttatcctacccttccaactcacctctgcataatctgtcttgtgtgataaatacccatcacttctattgcttagctgcttcacaaaaaagatggacattctgcagggcgatgtatgtatgtttaaatctatatacacttagacagtcaatgacattttataaaacaatgcttacttatacttacccttataatgtatgatgtttttatactttttgtgataaccaccaaatggatttagtagctattagttcaagatccattatttgaaaaacactgctctagggtatgtgtagtctatactccctgaactagtctttactggcatcaccaatcaaaaaatggagaacgagttaagaatacacactcaggaccaggggcttagtcaacttagacattagaaaagatcatgtgaacacttcaggactcctaataaagtcttcttaggtttagaatataaatatttcaattcttgagaaaacaaaaatttcatgtgagcctttctaataaaaataggctagaaggttggtggttatttttaacttatctgggaaacagaaggaagaggtagcagccagagatttccttaatttaagcctagaatgcagctttgagttacaagctgcattctaggcttaaatttactttgaaggagtaatcaagctttcttatccaaagcagggaaagggaggtcataaatgaagagcttgaggtagctttgagattccagaagctgctgtgggcccaggggaaatgaagacccctgaactaggcaggcccaccaccagctgccatgttcatactgccctcccaacaagctgaaaaggctcaccatgctctcaaactgctatgctccaattcagctttaactgggctacttcatactagtactttgtgtcactttcaaccccacaggacaagcctatagctcaggctcagcatgagggactgcaagcacctcaagagcaaagtaacatgcacatcacaaatgaagatcagaatgatttttatcttatctggttccagagtggtgatggagacaaaaatcaattacagacagaattcctgaaatgtaaattgtttttaatatatttaagagcacacagaagtcttgatttataaaaaaataaatatataacatgacaaatttactgatgatcctggagctctgaggtcaaactctttaaatgatcagtgaaaacataaaacatccatgatctgttaacacacacaggagcatattccagttgtaaaaaacaaattccttgaaggctcagaacgaacaaaaatcagtctttatggcagaaagcacatccaaagctaggcaatgaagttcagcctgggccacgtgaacctttcaccagccagcctataacctatggagccaggacaggaaagcatgatccttcagctcatgacgccacccaggcttccagacaactgcagaatgaaagagtccctcagaggctccccagcccctgctgccatcataaagcacgggagggattgttttgtccttagcggctctgtcctaaatttgagagcaggagactgagaaggttatgctcattaaatattgtcattgtaacacggaatggaaatcatgatccttgcccatgggcactgagctgaaagaaagaggaacctcacatgaggctttcctagagaccaggatgttgggtgagtgggcgtgcacttctcaagtgggcaaggaagaactgcttttctccagctgacatgctctcaggggtgaagaagtttagcttaaaatacctgatggcgctgcataaactggggatttgggaactgagtttttagctctgtgacacacaacataaaaaacaaaaatccagtctcattagctaaattcggattaaaatctgaaatgtttttatggagttgccaacaggctggaatgtacctgatacagtttaatctgcttttatttctttggctgtcttccaaaccactttcttcctgtaattcttaagttggctagttctccttcctcagaaaaattacccctaagaatcttcctaatagtgagggtgtacttccgaatagaagagtccttcggctgaaatggcatctccaaggcctacagttcgaatggggtctttacacaccaatactggtgtgaagtggaaggatattccctctctgtgccattctactactggcttgtttgggtttaatacaatcctggagcctgcctccgaatgggaagtcatgaactcttggggtgccctcagagacactcggctggtgtctatggtttctgtggcgcaggcctgtgtcccagccacacgagctcctgcagccacggctgccagctggttggcccagtgtccatccacagttgccaggatgtggtagaccagcgtgtggaaatggatcctggtgagatccgaggctctgcttttactcctcccatgttctttcaagatccagaagaggatgtcactgaccatgcccacatcaggaacaccgttccaggaagagagagaagagtgaggtccagaggctgactgggtgagaaataacagctcctgttcattcagcccaagggaagtcaccgcgggaaagacctgctaacaaaaacaacaacaggtatctttctgatggagataacctggctcctaagatgtcttatgacacagccagtgactaaatgacagggaacacaggcaggcagctttcttccttgatacaggactccctggccctgaagtcactgttttagctatcacacccctatcttcaccttcatcatcatttgggagaaactggaaagctgcagtaacattgtttcagatgcagtcttttgtgatatgccactgtaagacaaaaggcagaggtgtctatattttgtgtttctttccatggtccctagcttttgccactgcacacataggagatactcttaccactgatggggcatggctctcagttcctgaatgtcagcagtattagaccagtaaaatggagacctcaagcaacatactgtcagggttataatgattttttttatacaaaacaccaagaagcaaaaagcatacagtttcatgttagagctaagctttttaaaagcaggtgtgggttaggaagactgtctgaatttagcaataacactgtaagaaaaagattaccaaacaggtgcccgtgttttctgtctgatggggaaccacaatatccacctccctgtctttcttacttagcacttccctccttagaaccagagaaccacacttaaggtaacaatttttgcaggagagaggagtccttgtatgtatgtgtgcatgtataaaatggttttaaaaatttaatggcctacatctttgttggagcaatagcagctttccttcactgcatgttcttctgtgtcaggcactgagctaaaggctttatttcatccaattcttactgtaatcttctgagggaaggagggactgcctccattgtacagactaagcctcagaagggttaagtagacagttacagagaaaatgaaatagaaatggctcatttttttaaaggtgagaagaaaaacccaaacaaaagctatactgaaaaacaccaagagtgaacccaagtgtaaactatggactttgggtgctgatgacgtgcctgtgtaggctcactagcttaacaaatgtaccactctggtgcaggctgctggtagttggggaggcttgtgtgtgaggggactggaagtatatgggaactctcttggattctgctctattttgctatgcacctaatattaccataaaaaaaaaatgaagtctatcaaaaaaaaaaaaaacaaaaccaacgacagtcagccctccatatccatggcttcaaccaacttcagatggaaaacagagtattcaaggatgtggaacctgcagatagggagggccaacttgtctaatccacagattccacagggccaactgcaggacttaaccatctgcagattctagtatctgggaagggttctggaaccgcccccgccgccccacacaccgctgatgacgagggatgactgtatactgaaataccattttttcatctgtcagactgatataaatgcaaattttaacattctggtagcaaggatatgagggaacaagtatttgtaattattgccagtgggaagtaaactggtataattcttatggagggcaatctggcaatctcaaaattacaagtgcttttttatgctccagtccagctgttctacttctgagactttctcctaaatatggacttgttcacaggcaaaacaaaatcatgtatcaagttgttcactgcagcactgtgtgtaacagcaaagggcagtaaataaccaatatgtccatccagaaggttcaggttaagtaaacggaggtacatctacacattcattttaaccatatggctatgaaaagacagaggatactctccatgttagtgatgcaggaagatctccaagatatatttagtgaaaaaaagagcaaagtgaagaacagagtattcagtaggctatgctatctttttgggtaaaaagggatggaaaacaaaatcaggatatatttctgtattttcttatacttgtacaaaagaactctggaaataaactgatgaagggtgcaagtagggaaggggaggaagtagaagggagacttcattgtatatcttttcatagtttttgggtattttttaaccaaatgaatatattaccaattaaaattaggtaacactagattgccaggtgaggtaacttgcctgagttcatgaagcccgtgagtgcaaggctggcatgcgaacccaggtctccagagcttgtgttctgaagcttcacctgctcagatttatactagtcaatgctgctgcccagaggcaggcactgaacacccagatgcctgaggaaggagggaggttccctcaaagtttctttgctttgagcttcttgaagttcaactgaaagcagctgagctgggctttcagttttttccattcactttcaacttttccattccagaggagaaatatgatcaacaatctgtcagttacactgccataactttaacctagtaggagatactgctgtttcagaacagtcctggatccttatttggatctccatggacttgggtctgagtgacacaaacctacatgtcagtgagccagtccctgagcccaaacagatggtcccactgcacaaaaaagcttctctgcaaggctctatgaggatcagggccaaacgatggtcccatgaggttacctgatggacaatgctgctcatgagctccctgttagtcatactggccagctctaggtgaactggaataccagtggggatgtcagaaatggaggttacaacctgcaaagagaagaagataagcactgccattagaaatagaaggaagtcaagaaagagggaagaaaagatcagatcctgagaggcggttcctcctggtaatggccttctttgcatgctcacgggagctacaagcaatgtgggtccccaccacctctgtggacaagggacactcttcccaccagggaagactaggctgtgcagagccatcagggatacagaatcagagatggcagttcacttcgactgctgtacgaatctgtaggagttgcagcatagctgatgtgaagtgagatgatacaaataacacaaaggacacaaactacaaaccctgcagcttgcagccatggtcggtttagcacaggatgcagaggctcaggcaagaagatgttctgccctgtcctactcaagctgctgcccacatctgaagggatacagtgaggtgcctcactgcagcaggaggcaagctccacagccagctgccaagatatgtccctgggaggccaggacctaagacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagagaggaccaccaggtctggctgaaactcctccaggctagacacaaacacctccagcatattcatggccccgttggagaggtcgtgagagaagatgaatcggttggcatggggagcttttaactggccccactcctcccctggaaaaacccagtcaacacaatgggaagaaaaggaagaggctttaggtctcctagctgtgggggcactttcaggcacctcacaggagccttggctccaagcaggctggtttctggctgaggagaccccagcaacaatggcctaaggtcagcatggcactgcaagaaacaaaccaaaaacctaaacccaaacccagccaagaaacagaaacatagtatgggtgctatatgcctttttcaaggtaattagctccccctgagtcccaggagagccctacttgagctctcaaacacaggagagacagtacagaatggcagcatgacttccaaataccagcatacagtgtgcagcacgcacgccctgcagacagtataggctgtcattgtttaaagcacattcttcctcacagcattgccctgagcatctttcattcagttggaacttaagcaggctgaatttcttcccaacagccaagctcactgcatctcctcttccctgctgcccatcagtggtttctgggcacctgatccaaaggatcagactatctagctgctccagttgcttctatgtgagttgctttagaggaatgactgtttaaagacccaagttcaagtgctagttcctccctaaacatgaagcctttcctaatcctaccacccctaagcagacttgattacctcctttctggggccaccactgtaccctaatacaggactgaggcacatgattttgcaattcctttttcttttttccttttttttttttttttttcttctgagatggagtttcactctgttgcccaggttggagcgcaatggcgcgacctcagctcactgcaacctctgcctcccaggttcaagcgattctcctgcctcagcctcccgagtagctgggattacaggtacccgccaccacgcctggctaatttttgtattttcagtagagacggagtttcaccatgttggccaggctggtcttaaactcctgacctcaggtgatctgcctgccttagcctcccaaagtgctgggattacaggcgtgagccaccatgcccggcctgcaattactttttccaagtgtctatctctggcagtaaactgtgagctgagggcagggcctgtgtcatcctctgtcgtattccttctgcatcatgctgtgtctggcatatagccatgggaatgaattaacaaaagaacaagcaaataagagaacagactgatgacctaaatgcccatgacaacaaaaaatatgggtatgaaccccaaatccaacattttgcaaatcaacaaagactctgtacgatgggaaaaatacattacattgacattctccagagagcaagacgtggactcaacccttgaatagtgacactgctaggaaacacgacctaactgaacctaggagaaaggagccacactgtattgaaaatacactgatttcttcaggaagtgacagaggcaaaaataaacaggctcttctgcaaggcaaggatgagaagaaccgtgcagagctgcttgctgtttccacaggaaacaaggcagcagatgccaagagaggctggaacctgaagaaaaccaccagctgagatctgtgaaattctgtaacagtgccattacctccaagagtctcttcctctggagctccttgctttgtccctccatcatgtgcaatccagaaaggaccaccaggtctggctgaaactcctccaggctagacacaaacacctccagcatattcatggccccgttggagaggccatgcagggggcagatgcaaatggatctaattctgcctgtaatggtagttagcgcccctctttcctcacaaagtgttgtattcattcctgtaagcaatctcttctcaatgtatcatcctgccctcagccagtaagtcagcaaaacctctgcgtagtgactcactggattcccagcccaagcctgacaatgggcttctctggggagatctggtaagagagaatgtggaaaaaaaaatggacaaatcccttggaatttccctattgaggtcagagacaagctgggaatggatttctgttgagagagctgagcccagggctactgccactagactaggctccctccttggacctaggaaaatgtcacctcacaaagtttaatggaagtccactgctttgtatgcagaagaggcataggaaagaaaaactgaagtgtgaagcttataaacccaaggatggagacactctctttgtgcggtgaactgtgctgtctccttaactacatacgaggcacagctgtccaatacaacatcaaagtcttgctgaagacgtaagactctccactctgtagtcaccaggaaaaatgacaaaccaggaatcacaaaggtccccagttcctgctgtgggtgccaaaaaaactgacacgaatctggaactcatggcagcaatacctcaggggctcatctttagcaattccagacccttccagtccacagtcaggtcattcttttatttatttattattattattttttgagacggagtctcgctctgttgcccagactggagtgcagtggtgcaatctcagttcactgcaacctccgcctcccaggctcaagcaattctctgcctcagcctactgagtagctgggattataggcgcccgcctccacacctggctaatttttgtatttttagtagagacggggtttcaccatcttggccaggctggtcttgaactcctgaccttgtgatccacccgcttcagcctcacaaagttctgggattacaggcatgagccaccacgtgcggccaggtcatcttttcatccaagctgctcacaatgtttccgcacaccaaccaatctcttaatccttaccacaatgatcaggcagtaaaaactattactcttacttcccatttgggaaaactaaagctgagaaactcaaaaacttgtgtagcattaagtatgaattgcctacgtcaacgctgtgtccctaattttcagaccctatccttctttaattcccaactgattctagtaagcacccgaaagagaaccagaacatgttacaactcttttttctacctggagaaaggcataattctcaagaaataacatagttcatatcttatgttaaagttaattactctagtagagaagattctcttaattgacttggaagtagttcactgaagagtattaagtgctgctttaaggtaccaattagtctgtttagatgcttgagtctttaatgtgtattaacaatgtgttgaatcagaaactcaagagtctgagttctgagcagagggaaaattacagcaggaaatacacaggatcaaagtatgtccaagtatttaatattctctcagaaaccagatgcctaatctacgtaacatataaaatctgctgggaagaggggatgggatgcagtggatgtggatttattaacattagaacatctgatgggaaacaatatagtgatgttaaatacaaaacacttccattcacacacccaaggaaaaataaaatgctccagagaaacttgccagaagcttggaatcaaccccaagcagcttggaagagtcagtcagaaaggcctagggcagaatccagcacagagttgaatggatgctacctgcctttctcttgtcttagtcataaaggaaaactttatatatgtgtgtttaacacgttttcacttttatttgagatgcttgctttcctatgacctgatttatcttgggttcggagcaattctgcttgtagacctgggaattttcttccatgttataatactcagtctcccttgagacaacggccagtatcagctcagtagaaccaataggtcaggaaactttcagtatggcaaaaacaggatcctgctaatttacaaagataaatttccggcacagtcacaccccaatctgacaatacacagccccttgactggtcttgccaccattacttactcatttccttacctgcttgatactctaaaatgaggtggaactcatccacttcctgcaatgactctggtggaacaaagacattgtcatcaagaagctcatgtagctttggaccaactggaccgcaaagaagaacctggaggcaagcaacacgaagtccatcaggagccccgttcctttccccacagaacctcaacagcaccccaggacagtacattcaggctgattctaatcatttcaacaaaatattggaatccaaatctaattttgaaagctgttggtctggaggtgtgcggcagaaggcatgtcaccagggctaaggcctctggagggtatggccataatgtacccagaactgagaggctgacaaaagaactgtgtcacagccgtcaggcacctatgcagctgctacatctcattccctctgctgcggactgcacgtttgtgtcacctccccaaatttagatggtgaagcccaaacccccatgtggcttatttggagatagggcttttggaaggtaattaatatgaaatgaggtcataagggtgaggtgaggtcctaatcagatagaactggtggccttataagaaaagagagagagatcaatctctctccccccaccgcatgcaccaaggacaggacatgtgggaacacattgagaaggtggccacctgcaagccaggaagagacttctcaccagaagccacaccttgctggaaccttgttctggggctttccagtctccactgtgagaaaataaacttctgttgcttgagcccccaagtctatggtattgtgctactatggcagccaaagcagaccctacccccactttctttactcactcacaccttgtgcaggcaaacagacatgggatgttgtctgcaacaaagctgccagatgaaaactgtttgagtttttatacagtataaaaaaagtttctggatcaccatatcctcaaccgggtgacctcatttgtggaataaaattctctcccattactgaactgttaagtgaataggacagcctttccaatatgagaattaaagagcatcccaactgagagacttcaggggaaggtgctctgcaacttttccaaaacctttttcttcaactccaaccagagcctccctctggctattctttctagaagccatttcgtatctgttcctgctcctcaactccaataaaccgctgtttttgacacaacattcaaggccaggctagcagattcaaaaccactgaacaatgaggacggcactgagatttaaaggaaagtccacagagattatcagcactgcttcatgattttttttttttttttgagacagagttttgctctgttgcccaggctggagtgcagtggtgcaatcatagctcaccacagccttgacctcccaggctcaagcgaccctcctgcctcagcctcccgagtagctgggactacaggcataagccacaccacctggctaattttttatttatttttaatttttttgagacagagtctcactccgtcaccaggctggagtgcagtggcacaatctcggctcactgcaatctccacttcccaggttcaatcaattctcctgcctcagcctcccaagtagctgggattacaggcgcgtgccaccaggcccagctaatttttctatttttagtagagacggggtttcaccatgttggtcaggctggtctcaatctcgtgacctcgtgatccacccgccttggcctcccaaagtgctgggattacaggcatgagccaccgcgcctggcctaattttttatttttatttttaatagagacaagacctcactatgttgcccaggctagtctcgaactcctgagctcaagagatcctcccaactcagcctcccaacttgctaggattacaggcatgagctaacatactcggtctgtttcagatttagtatgtcccacccagaagcttcaaaaggcattaacttgctaattaactgcttatatagactgctttgtacagaggtactttcgtgttatttaagaaatcccaccttctggataaaaacatactcctctcccttttctgccttgacacatgcccattacaggccaattctgaaaaagtcttgccccaaccactttacttcctttctctaattcttggctagtgcttcacttccaagatgagacaacaagggccataggccatatttaccctcctgcctgaaacaacaaaaaagacaaaatatatgaaacaatggttttcaaaacattgtgtgaacatcagacaataaaggacgatccctaaaaaacaggactaaactggccaggtgtggtggctcatgcctgtaatcccagcactttgggaggctgagacaggcagatcacctgaggtcaggagttcgagaccagcctggccaacatggtgaaaccctatctctaccaaaaatacaaaaaatttagctaggcgtggtggcacacacctgtaatcccagctactcaggaggctgaggcaggagaatcacttgaacctgggaggtggagagccaagatcatgccactgcactctggcatgggcgacaaagtgagattctgtctccaaaaaaaaggaaacaggaataaacttagtaagccctacaaatgtcttagcatattactgtaaaagaatttccaggtatacggaacctgaaagaatttatcaccagcagactcgcaccacaagcaatgttaaaagaagtccttctggcagaagggagaatgacatgagatggaaatatgtttttatatttttttgagacaagagttttgctctgtggctcaggctggagtgcagtggcgtgatcttggctcactgtaacctccacctcctgcgtttaagtgattctcctgcctcagactcccaagtagctgggattatggacacacaccaccacactcggctaatttttttttttttttttttttgtatttttagtagagatggggtttcaccatgttggctgaaacaacctgaccacgccaggctggtctcaaactcctgacctcaaatgatctgcccgtcttggccttccaaagtgccggattacaggcgtgagccaccatacccagccaaaaatatggatctaaacaaagaaatgaagaacaacagaaatggtaatgctagataagtacataagattatttttcttattatttaaatctctttaagagataactgaagagaagtactaacaaatttaatgtgaggtttgtaacatgaggaagtcaaatatctcataataatagtataaagattggagggagagaagtacaggcctacctcattttattgtgcttcactttactgtgctctgcagatactgcagtttttacaaattgacagtttgtggcaaccctgtggtcccctatgggcaccatttttccaacagcatgtgctcacttcgtgtctctgtcacattttggtagttctcacatttcaaaggttttcattattatgtctgttatggtgatcagtgatctttgatgctactattataactgttttgggacaccacagatcattcccacataagacagtgaacttaatcaataaatattttatgtgttctgaccactccatggactggctgttcccatctctcgccctctccttgggcctcactaatttcctgagacataacaatattgaaattaggccagttaataaccctacaatggcctctatgtgttcaagtgaatggaagaatcacacatctctaactttaaatcaaaagctagaaatgattaagcttagcgacgaaggcatgtagaaagctgagtaaagcctcttatgctgttagccaagttgtgaatgcaaaaagtccttgaaggaaattaaaagtgctactctagtgaacatacgaatgtaagaaagcaaaacaaaacagaaacaaaaaacagcaacaaaaggaaagcaaaacagccttattgctgatatggagaaagtctgaatggtctggatagcagatcaaacaagctacaacattcccttaagccaaagcctaatccagagcaatgtcctaactcgctccaattctatgaaggctgagagaggtgaggaagctgcaaaagaaaagtcagaagctagcagaggttggttcatgaggtttaaggaaagaagctgtctccacaacataaaaatgcaaggtgaggcagcaagtgctgatgtagaagctgcagcaagttatccaaaagatctagctaagatcactgatgaacatggctacactaaacaacaggttcgatgtatacaaaacagccttctgttggagggtaatgctgaagaagtacgtaaaattattgtaagaagatgccatctaggactttcagagctagagagtagaagtcaatgcctaccttcaaagcttcaaagaacaaactgactctctttttggggctaacacagctggtgactaagttgaagccaatgctcactgaccattctgaaaaatcctaggattcttaagtatgatgctaaatctactctgcctgtgttctatatatataacaaagcctgaatgacagcatacctatttacagtttaataggtattttaagcccactgttcagaactactgctcagaaaaaaaaaaaaaaaaatgtttgaagtatcactgctcattgacagtatacctagtcgcccaagagctctgatggaaatgtataaggagaaggatgatgttttcacacctgctaatgcaacatccattctgcaacccataaattaagaagttattttgactttttttttgagacagtctggctctgtcgcccaggctggagtatagtgagtggcacgatctcagcccactgcaatctccacctcctgggttcaagtgattcttgtgcctgagcctcctgagtagctgggattacaggtgtgcaccaccacacctggctagtttttgtatttttagtagagacggggttttaaccacattggccagactggtctcaaactcccagcctcaagtgatctgcccacctcggcctcccaaagtgctgggattacaggcgtgagccactgcacctggctggaattttgtcaagtctattatttaagaaatacatttcataaggctatagctgccatagataataactcctctgatggatctgggcaaagtaaactgaaaacttctggaaagaatttaccattctaaatgccattaagaacatttatgatttataggaggaagtcagcatatcaacattaacaggagtttcaaagagattgattctaaccctcttggacgccttttgagattcaagacttcagtaaactgcagtaactgcagatgtggtgaaaacagccagagaactagaattagaagtggggcctgaagatgtgactgaattattgtattcttcatgataaaacttgaatggataaagagttgcttcttatggatgaacaaagaaagtggctgagatggaatctacttctagtaaagatgttatgaatattgttgaaatgacaacaaaagatttagagtattacatacacttagttgataatgacaaatagcaggaaggtttgagaggactgactccaatttttagaagttttttaatttttcatttttagagataggaatttgctctatcacccaagctagagtgcagtggcacaatcatagctcacagtacagtagcctcaaactcctaggcttaagagatcttcctgcctcagcttcccaagcagctgagactataagcatgcgccaccatgcctagctaattaaaaaaaatttttttttagagatggggtctcgctatgttgcccaggctcaagtgatcctcctgcctcattttcccaaaatgctggaattacaggtgtgagccactgtacctggcctgattccaattttgaatgaagttccactgtgggtaaaatgctatcaaacagcatcacatgctacagagaaatcttttgtgaaaggaagagttaactgatgtggcaaacttcattgttgttttaagaaattgccacagccaccccaagcttcagccaccaccctgatcagccagcagccatcaacatcaaggcaaaacactctgccagcaaaaagattatgaccgtctgaaagctcagatgattgttaacattttttggcaaccaagcactctaaaattgtgtacactttttttcagacataatggtactgcacacttacttgacgatagtacggtgtaaacataccttttaatgcactgggaaacaaaattcatgcgttttattttattgcagtatttgttttattgcagtcgtctagaaccaaacatgcagtatctctgaggtatgcctgttatcacttgaaagtagaccgtgataagctaaagatgtacagtataaaccctaatgcaaccactaagaaaaaaagaattatacctaataaagtcagagaagataaaatgaaatcatagaaaataatccaaaagagtacagaaaaagagggacaaagatagagatggggcaaacagcaaacaaatagcaagatgttagatttaaacctaacctgatatatcaataatcacattagatgtaaatggtctaaacactccgattaaaaggcagagattgtcaaagtggattaaaaagcaagccccaactatacgctgtctataaaaaatacactttaaggtaaaaagatgcaaatagattaaaagcacaaggacagaaaaagatataccatgccaatactaatcaaatgaaagctggaatggctatttcaatcaaaatagatttcagagcaaagaatattatgaaatgattttatttatccctagtaatgataaaggaattaattcattaaagggatgtaacaatcctaaacatttatgtacctaataagagtttcaaaatacataaagcaaaaagttacagaactataaaggaaatagacaagtatccaaaattacagttggagacgtcaacatacctcttaataactgacagatcaaatagacaaaaaaaaaaaaaccaataagaatatagaagacttgaacaacactatcaatcaacttcatctaattgacatttacagaacactcgacccaacaacagaaaggcttatgtatattcttgaagctttcaagtacacacagaacctcaccaagatagaatattctgcaccatgaaaaaggtctcaaaaacttagtaggattcaggtcatagaaagcatattttctgaccatactggaattgaaatagaaatcagtaacagaaagacatctggaaaatccccaaatatttaggaactaaataacatacctctaagtagtccatgaatgggctattaaatggcacatctcaataaatcaaagggatattagtattttgaaatgaatgaaaataaaaataatccatcaaaatctttgggatgcagctaaagcagtacttaaggggaaatttatagcactaaacccctatatgagaaaacaggaaaggtctcaaatcaatgattgtagcttctcaccttaagaaactagaaaaagagcaagtcaaatctgaagcaagcaaaatccaatgaaaatagaaaaacagagaaaaataaattcaccaaaagctaattacttattaaaaagagcaataaaatttataaacctctagccaagctgatcaggaaaaaaaagaagatacaaatgaccaatatcaggaatgagaaggaaaacatcattacaaattgtagagatcttaaaggaataatagaataccataattaactttatgccaataaatccaacaacttagatgaaacaaattccttgaaagatacaaactactaaagctcatttaaaaaaaaaaaaggaaaatctggatttccctatatctattaaagaaatcagttatttaaaatcttcctacagagaaaaccctgggcctagaaggcttcactagaaggcttaaattctataaacatttaaggaagatacaataccaatgcgacactcactctgttttaaaaattgaagaaagggccaggtgtattggatgaatccaagcactatggaaggctgaggcaggtggattacttgcaatcagaagttggagaccagcctggccaacacagtgaaactccctctctactaaaaaatacaaaaattagctgggcatggtggcacacacctgtagtcccagctactcgggaggctgaggcatgagaatcacttgaacctgagagacggacattgcagtgagctgagatcgccaccactgcactccagtctgggcagagcgagactccatcttaagaaaaaaaaaaaattgaagagaagataggtgtggtggctcacacctgtaatcccagcactttgggaggctaaggcaggcggatcgcttgaggtcgggagttgagactagcctggcaacatggtgaaacctcaagtctacaaaaaatacaaaataattagctggctgtggtgacgtgtctgcaatcctaaatactcaggaactcggctgaggtgggaggatggcttgagcccaggaggcagaggttgcagtgagccgagatcatgccactgcactccagcctggatgacaaggccagatcctgtctctcaaaaaaaaaaaaaaaattgaagagggggaaacactttccaacttattctacaaggccagtattgccctgacagcaaaaccacagacattacaagaaaagaaaaatacagaccaatattattcttgggcattgatgtaaaaattttaaacacaattttagtaaactgaatatgtgaaaaggataatgaatacatcagaacaaagtaagctttatcctagagatgcaaggttggtttaatatgtgaaagtcaatataattaccatatatcaaactaaaaaacaaaaaaccacacaataacctcagtaaatgcagaatttgacaaaagcatttgacaaaataaaataactattcctaattcttgcctaattccacaagtatatatttttttgagatggagtcttgctctgtcgcccaggctggagtgcagtggcgcaatctcggctcactgcaacctccgcctcccgggttcgagcgattctcctgcctcagcctcctgagtagttgggactacaagcgcctgccaccatgcccagctaattctttgtatttttagctaagacagggtttcaccatgttggccaggctggtcttgaactcctgacctcaggtaatccgcctgcctcggcctcccaaagtgctgggattacacaagtatattttttaaaggcacggttcctctcctgaaatttggcttctattctatcattccactaaacctgcctttactatattcaccagcgtctatttcaaagatgcaatatagcatggctattaggagaatggattctgaagcttgactacttgggttcaattcccactctactcattatcaggtatgtgattttcaccagttttaacttctccatgcctcatttttcctatctgcaaaatggggataataaaaagacttcccttatagggccctatgaagatttaaattggttcatacacatttaaagcacctaaaacttaaaacagtgcctggtatatggtaaaaaactatagaaggaagtgccagctataattaccacctctggaaaatacctagttcttaatctctgtagttctcagatgatctctcagtccatgttgagaagcatttcagaaagttaaactgagtctctttgagagtgcatacagggtgaagtaaaggcagagcctgacacttgaatcctgactctatcatttactagccaggtgcccctgggcaccttacttagcctctctagacctctgtctttgaaatcataagactgttgtgaggattgagtaacagaatgcttctctttcctcagtctcctaccaaagccagacctgttttattagaatgccttccaatcagactggtcccaggaccagctactccagagaccaagagcaaatgctggtcccaggggaggtcaatactgaaaggtcaatcttgtactcagccatgaccgtcctgggtattgtcttcccagagggcagaattatttctcaggatcaggagggtggcttcttaggaaaccatgaaaactcctgggattctgatgggaatggcctgggctctctctaaagggcttatgatcaatctccttttcttccacccattagctggtaatatttccaaaggtcagccctggaatttctaatcttctctatttgggagttaattacaatttataaacataatgactgcaaaagtctttattttctttttattattctttcttaaaagtattttctaccctaatatttcatgagaactttgattcctattaaaatatgaatgttcacattttaatatcctctctaaactgaaagcacatctatctccaggtgtatagtgtggctccatatgaatttttccctgaaactgctgatgacctatccgtatttctgagttcatctctggcttctggttccaccactctgactcacatttctatttttaggctggtcccccaaaactagaagactgttcacagtctgttttctagtgttagcggccacaaccattctgcactgatcaaggttatttactccataatcatctttgataaatctcttctttgttccccatgtattgtagtaggttttagatacatgtttctcctctctggctgctctaatccaaaccttaatcattatacaggaaaacagcgataactttcttgttggcctcccccttcaggcctattctactcatagcaagagaaacttcttactcaggtgttactgtgaacatggcaacgatttttaattctacttaaaccaaacaatttaagtcttgaagacactcccctactgactctcatctagtggcttttattttttggcactctggatccaggctcaccaacacggccaaccgttgttttccctcatgacttgtataatccttagtctcaaggcccacatgctcctaactattaaatgatatggtgcctaagaacatgggttattgggtcagactgcctgggttaaatttctcattccattaccaatcagttgtgaacctctgtgtgcctcaagttttctcatgcagaaaggaagaacaatggcagtaccgactagccttacagggtttgttgcaaggattagataatctatgcaaagcactaaagacaatgtcaggcacagagtaaacactcaaagtattagttactactatctcctactattactgcttcctaacaaaagacccagggtctggtacatagtaggtgatccataagttgaatcaaggaatagatactcattcttgctcctaaaattattgaaacactagggaaaggcataggttttaatctaaaaacttgacctacctttaaatctgagttggctgcaaatttctgtccaattaaagctgcatttcctcctacatagtgctgtaagagagttcaaggcttttagacagtattttaatacaactatatcacccaagtttaatcattttttattttaaaaattaatttatagtccatttcccaaaaacattttgaggtgattttacatcaaaggacacacagatgaagtgaatgcaacacagaaatagaaagtgagtaataagatgaagaaaataaataggacaaccatgaaaatgagtctgattgctttaactgttgatcaaattcagctctgagcttacagacagccagaagagacacaggaaacaggaaaagtgtggacagggcttatcgtctacattatagtccttctaaaatgaagaaaaatttcactatcctgtggaaaaatcattcagtagatactataatgaactaaaatctaactcttgagtgaggcacatatggcctttatctaacccatgttttccttactaccttcatctcctgcccttcccttccacaccctgcttacagctctccaagtcagccttcccctgtctctgtgcctttggcacatgctgtttccttccattaggacaccctccctttctcatatactaggtaaaaccctgatcactttccaagaatcagctgcagtgtcacctcttctgtaatgccttctctgttccccttacaccccactgacatctcagccttcacaaccgccctcaccagataggattacagatctcttcctacccctataacctgaacaaacctctaatgcagctcttgtctgcttgggctactatcatctgggtacacaactaggtccttcggggcagggactgtcttcttctgaagtgttcagtaaatgtttgttgctaaattttgagaaacgaagaaacacactgatgtgttgggaaacataaaagttttcctgggagtaaattctaaagataatgggcccctaatataggacagtactttcccttaaacaccacatctctcagctgaggacctggagaacaaataattcaaggttggtgttccatgttgctaaggatggatccatatgccttggaaatctgacacataacagctaaggctgctgttctattataaaagttgaaaagcctgatagtgttacctgggtggaatgctactatcccagcttcctagtcctcagcccacgcagaggcatagactaaaccaggggtgtccaatcttttggccgccctaggccacactggaagaattgtcttgggtcacacataaaatacactaacaataacgacagctgatgagctattaaaaaaaaagggtgggggggaggttaaatctcataatgttttaagaaagtttatgaatttgtgttggaccacattcaaaggcatcctgggctgcagactggacaaggttggagtaaacaattctagatggtagacatcactcttatcccaattttgtgctgactaacctctgaattcaggtgggacagtaatagctttttagagataatttaaaactttctgtgatatgtaggctgaaatttggccctttaacatgtcagccttaatgttttattcaaccacgatagttagaatttactaaaaaaaatcttgggaaaatagtaagatatctacaaagtggatttcagaattttcatataatgtttatcaacctgccttaaactataaggaagtatgaaaaggcactcctctagtgaaaggggttttacaatgttaagaaataacctggaccatcacaaagctagatcaagttgctgtaaaaatttttttcatcaagaaataaaggcagaatcaagagagaagagaaatcaaactggtggtttaaattccgtaatcataaagacttttgagcagtgaactcatcatgttagaactatcgagattctctcataagagataagaatctcactactgatcccagttgtcaaaatgataactgaaatcttaacttgctgtcacctttagaaactcagctaggtaatgcctatgtccatttctaatgttcaaataggcagcttcgaagacaaaaaacttatttttaaaatttttttgagacagggtcacaccctgttgcccagactggagtgaagtggcacggtcatggttcactgcagccttgacctcccgggctcaggtgatcctcccacaggcacatgccaccatgcccagctaattttttgtattttttgtagagacagggtttcaccatgttgcccaggctggtctcaaactcctgggctcaagcaatccacctgcctcagcctcccaaagtgctgggattacaggcgtgagccactgtgcccggcctaaaatcttaagtcatcaaaataaaagtagtcacaaaggtttgcctgtgaaaggtgccaattaaaaatggcattaagagcttccctggctagaactaccaaaccagactgggtgcccagccaaagggaggtttaaatgaggaggaagaatggggtgggggcaagacatgggagataaccaaccaaccaaaactcagcctcaagaggcatgagggtacatgtaggagcaggcatactggggtgaggtaggaagagccatggttgggtctccagccccagcactgcctcttattccacgtgaacctccaggaagtgcctggaccatgcagggctttgtatataatcaccaggtgaacttggaaaccactaaggttctaacttcgacaggttctaccttgcagaccagtggttctcaaaaggaggttctcagacctacaggatcaaccaggaaacttgctggaaaggtaaattcttgggtcccatcccacatctactgaatctgaactctggtagtaggcccagaaatctgtgtttcaacagcctctccaaatgattctgacacatgctcaagtctgagaaccatcaacctagacccacagttttcaaccaggggtgattttgctcccctcctcttcaaactggaatgaaaagttgcttgcttgcttctaggaaccatattaaaaaggcatctttttccacccttaatttactattgctgaaccaaacagacctgggctcctgggaactctgatgcaacctgggcaatgtcgtgaaaagtttccttatcactgaagaagcgctcagcagctgctcccttccccatgaagtgaatgaaggcttcttccagatcattccttgaatgcagaatgctgtgatctttcccattcccaggactaaggccaagtgcctgcaagagcttcacccctgagagcaccacatcaacacatgcattgactctagaaggaggaaaaaaactgtgtgaaagcagcagaagcaccaagtagccattttgcatttaacaaaaggaaaatgtttctcagaaccttattcaacagaaaaaacaggaagtaggtctgaaacctgaattgggaagtaaacagcacatggcaggagaaaaattactttaactggatttatgtattagcatcagaacacaggactcttcaataatttggcaaacttttacactagttacaaagtgagaagataggtgcttagcatttcagaacaaagctactgtaacaaaaatgtaacatttctgagaaaaacgctggcagagccaaacaggattcatgctggccgtgtgacttgggcaagtcactaatttctctgtgcctcggtttcctcatccacaaaatggcaataatatgagcatttaactcatagagctatggttaagattaaataagtgaatgtatacttaggaacagcaattggcgcagagtaagcaaaatatgtgtttcagtcaaaggctaggtatcaggcatcttccctctaaaaacaaatgaggatggtaagatacaataaattcctaaatgcctgagtactcccagctgaaaccctgcctcttagaatttagtggtgttttacagacttaggcacacctgcagcattttaagaactcaccctttggccagtgttcacaggactgacccatgaacgttaaagacctgccactcctggttgtctcgatggaaattataaagtacaggttgaatcccttatctgaagtgcttgagatcagagtgtttccgattttggaatatttacatatacatgagatatcttgggaatgcaacccaagtccaaacacatttcatatatactttatacatacagcctgaaggtaactttatacaatgttttaaatacttttgtgcatgaaataaagtttctattccttacgtgtgggtggaattttcacatataagtacttaatatacatcagtggcatcatgtcagtgccccagagttttggatttcagagcattctggatgctcaacttgtactaaggttgtctggcatgacctctcctatgtgtgtatggagaaagtctgtcttacattttcagggtttctttgctaagtcatccctcttttaaagagaacgttcaaataattaaggtagctagatgaggtcttcccgcccctacccctatcatggtcatctttattcctgcctctgcctattgggatgtcattctggccagtgaggttggattaccacacaggcagctcccagccggcaaactgagaccacccctagtgatacgggtgactgggcttcagagttaattctgagcagctctgaaaccacaaggtaaactcattaataaaaatgtcccaatggatgagattttggtgtaaaatacatagttgtatttcccttttagtctctttcaaaaatgaagaggaatgagactgggatgaagaggaattttaccaggtatatttctacttttaacatgcttgtattccttttagaatttttaaaatgacataactttaaaaaggtttgtatgcagactagatattatttacatcacttaaggaagatttacaagggcaaggaagagacatcctccctcaagacacaaagagactgcatcctcattataagggtcctttttattaattcttcccctagggattcatgttttgaaaggagttttgcctatcaaatagcatttaaatactcagtttcttgttcaagacacacataatgactctggtcaactggagaagcataacctaagatttactatgcctttcagtgcataaaacatctagctactgtatttggcccttctctttaaaagagggatgatttctagtaaagaaacactgaaaatataagccagaacttctccatgacacacacagaaggggccattctggacatgcacgtggcagttgcttaaagatatgtttaaaatctttcctttcacaaccttcaatgttaagaaaccaaacacaccttgcaaactggtctcaattttacctcagacatggtgccctttatttctaatgaatgcaacattagattggtagaatcaacaggaatacaagtatctgtagctctcagacgccagtaggttcctaagtttcagacagtgagggcttgagtaaggagggataccatttcctccagacagcccagtctaaaaaaattgtatccaaatggatttgggtcccgagtctgaagagtaaaggttcagaaatggagggaaacctgtctttgaaaataactacttcaaaaactataaacaccctcaagcctgtaatcccagcactttgggagaccgaggcaggtggatcatgaggtcaggagtttgagaccagcctggccaagatggtgaaactccatctctaatgaaaacacaaaaattagctgggtgtggtggtggacacctgtaatcccagctacttgggaggctgaggcaggagaatcgcttgaacccgggaggtggaggttgcagtgagctgagatcgtgccatggtactccagcctgggcaacagagcaagactccatctcaaaaacaaaacaaaacaaaacaaaactataaacaccccactctccatatctagtactgctgagattttaaacagtctgactccttaaaatgagaatggggaaagctgttcagtatattttgtaacacaaggcaaaacccaacagaactaattttgagttacaaaatatcactatcatggaacattttccatccctcacctaatcataccaggaataccgggggaaaataaccagtttttcagactggttcacagtttacttgataactttttataattaaaaaaaaccaggctgagcacggtggctcacacttgtaaccccagcactttgggaggccaaggcgggtggatcacttgagcctaggagttccagaccagcctgagcaatatagcaagaccccgtctctacaaaaaatacaaaaattacctgggtgtggtggtgcacacctgtagccccagctactcaggaagctgaggcaggaggatcacttgagcctgggaggcagaggttgcagtgaaccaagatggcaccactgctcttcagcctgggtgagagagcaagaccctgtctcaaaaaaacactgaacatctactacatgccggatgccaaacaagtactttacatgtactttcttgttctgttttataatactttaaccagaataagaatctttctctgcactttctcaactcaatagcatcccaaaatgtaaaaagcatattacctaaggggctgtattgtcaaggggaaataaagggagacacagttaaagaatcagaagacaaaattatgctcatctgacatgcaagcagaagctcacacttcagtaaaaaatgtatattagatgactgtgattttggagaaaacacagatgaaacaactagaaaataggtcaagacaacagatgctgaatgtcaaaatgggttggggggctggcaaagagggcacagttctcccttctagaccataagtgcctctaaggcaaagacgatgtttcctatctcctcccttctgtttcatcacctgtaaaatgttttctaaggttttctctagctttacattatgtgcatcagctgttataagagctaatcgtaattgttaagacatagaactgtaaagaggcgggggaaaaatggctagggcagtggtccctgtgctgaaccctagctcctgcatctagatagaagaaaggcggctgatctttaagaagcaccccacgctaggcaggcattttcagatagattaaacctatttgcaaaatgcggtaagatcgctaattagtcatcactgctttcagctgagaagagtgaggccatggattaactaacattccaaagcccacagacaggcagagctgaaattcaaacccagatttatctgatgatactgaaacccacgtaggaagtatacacaagcaaagttgtacatgaagggattaaccttgtgtttggatacaataaagaattatctagctagaatggagaattcatacaggggagaagaccaagatatgtttcaaggttcagggtgaagccagttccaggggcaataaatattagcatgagggtttttttttttttttttttttgagatagagtctcactcttgttgcccaggctggaatgcaacggcgcgatctcggctcaccgcaacctctgcctcctgggttgaagcgattctcctgcctcagcctcctgagaagctgggattacagaaatgcatcaccacgcctaatttttttatttttagtagagatggggtttctccatgttggtcaagctggtctcgaactcctgacctcaggtgatccacccacctcagcctcccaaagtgctgggattacaggcgtgagccaccatgcctgccgggtttcatcatttttaaaccaatgaataggtaccagagtctgatttagaagcaggggaagtttcctagaaacgccttaaaactcctcctatcctttacttctttgaccccttttcaccagccccttaatgcactagcatttaagggctagtgcctcccagaattccacctttaccatttttaccttctcctcttctcttcctgggtgatcctatccagtctctggcttcaacctaagtgccagtgtctccaaaatttgcaatcctgtttctcaatatattcctaaaaaccagcttctcattttcagtagctgacagagaagcttcatctgaaatcccataacaatgtatgtacatttctcctcctctgaaatccaatttatcttctgaaacttgtttttcttaaatctctcttaatggcaacaacatggcatcaacaaggaaccagaaatgggaaagaccaggcttcaattgctcctctggcacttgatagctacaagatcttgggcaaataaatcaatgtgagaagactcggtgacaatatctgttatctgcctccctcataaagttgttgcattagtcaattttcataatgctataatgaattgcccgggactgggtaatttataaaggaaagaggtttaattgacttacagttcagcatggctgggaaggcctcaggaaacttacattcatggtggaaggtgaaggggaagcaaggcaccttcttcttaaggtgtcaggaaggagccgtgccgagtgaatagcagggaagagccccttataaaaccaaaggatctcatgagaacgaactcactatcaggagaacagaatgggggaaccgcccccatgattcaattacctccacctggtctctcccttgattagcttatggggattacaattcaagatgagatttgagtggggacacaaagcctaaccatattagttgttataagatatttaatactgggctgggtgtggaatcacagctgtaattccagcactttcagaggccaagatgggaggccaaggcctgatcccagtagttgaagaccagcctgagcaacttggcaaatcctgtccctaccaagaatataaaaattagccgggtgtggtggtacatgcctgtagttccagctactcgggacactgagcatgacaggtcaaggccacagtgagcttgaacatgccactgcacacgccagcctgggtgacagagtgagatgctgtctcaaacagaaaacaaaaactaaacaagatatccaatattaaaaacctgtcgtttttgactgcctttctttactccaccacatccaaactattattcaggttatctctcaaatctcacctcttctacatcattgccgagtttggttcgggctcctttctccctttacacaaaccctacaatggcctcttaaaccagtgtcaggatgtcaagatattcctccttatgaatcacattaaatggcattttgagtgtgtctgtgtgacagagagtgtgaatacgagtgtgtctctagagaagtcaaactacaacctcaaaatgagattctgatacaagtactacacctgctccccctcatccctcctatatccccctatctttgggctaaaaatcctctttgggtaataaatgatgagaagcagtgaaacagtttagaaccactgctcaaaatccacccttcacattcccaccaattctcaacaaagaacttgtcatcagttaactacttacaaacctttatggcttccccataaaaggcccttcacaatctggtccaacccttcgttctcagcatcatctctttacaaccctctaccataggattctcgctccaaaacaaggccgacctgttcccaaacaaaccatgtactttttcacatttggttctcttgcctaggtggacctgttcccactttggcttgaagaaatctcatttatttagtgtctgtcctatgaaagtcactgtagtaaaatatattttccaagatggtggcaataagatgccccattccaaatgttcttttcacaatgtgacactgatgctcctcccatcaaggtttgttctatgtcccctcccttaaaaccaggtggacctgtgactctggtagaagagttcctatgtgcttctaaggtaaggtcgtaaaaggcattaaggcttctgcctggtcctcgtgggttgttcctcttctaaccataattgttatggattgaattgtccaccccccaccaattcatatgctgaaaccctaattcccaatgtgactatatttggacgtagggcctttaaggaagtagttaaggttaaataaggtcatacgggtgagccctattccaaaaggacctagtgtccacataagaagaataagaggcaccaggagtgtacatgcgcagactaactgaaaagccagctggctgcaagctaggaagagaggccacatcggaagccaatcctgccaacaccttgatcttggactatcagcctccagatccacgagaaaacagatttgttgtttaatccacctaatttgtggtattctgttctagcagcccaaatgactgatacaataatatgtttccaacaagtgagacaggggccttgcttcacccatctctgtatcttaagaacctagcacagacctgacactaaccatgtagttggtgaatatctgctgaatgaacgcgcataaagcaaggaaggacaatttaatcccagcactttgggaggccaagatgggaggctggcttgagctcaggagttcgagaccagcctgggcaatatagcaagacctcgactctactaaaaaaaataaaataaataaaaaattggctgggcgtggtggtgcttgcctgtcgtcccagctactccagaggctgaggcagaaggatctcttgagctcgggagttcgaggctgcagtgagcagtgattgcaccactgcactccagcctaggcgacagagagagagaccctgtgtccaaaaaaaaaaaaaaaaaaaaaccccaaaattatagctaatatcgaatgctttttaaagcaggcactatgctagagagattacatgaatgatgtcatttaatcttcaggccaagtttgctctactttacccctcccggccccaacactccacagaaagtagtgagctacatggtagagggcctgcttttatgtggtggttatacataactctgagattacggcaagaaagtcaaatcgaactgagacagggactaaagttagtgtttacagtatcaatactataaagaaaataattacattcccaaggaaaagtacaaagaaaggaggtagtgtcatttggaagaaccttaaatatgcagtgtcactgaagtcaggggaagaaaagaatttcacggagaagggcgtgttcaatgcgtggaaggctgcagagtagataatgaagattcaaaaaggcaaatctgagaggagttgcagtacagtcgtgtggtttctagactacacggcgtttcgaaagtgggtaaaggcagacatcacgcgtcttcaagaagttcagaagaaagaggaagagtgttgtcatagtgggtaaggtcaagtatctttgattgcaaaacaacagtcgccagaagagaaggggctaaaagttggaacgaggaagaaggctcggagaaaggtgtcagacaaagcgggattagcaagaagctgttagggctggtcctaccgggatgagagaaaggcgcagaggccagccgagtggaaagagcagcggtgacgaaccgggttccactcagacgtccgacacttctcgccaaggggccagcgcggacagcagcgcctcccggggacctctgagaagccctgtttctgcgcggctccgcccgacctccaaggccgacctcggaggctcagagacccaggccccgttggcactcaccccactgccacgcggcgccagcgccggactggccgcacgataagcgcgtcccaggctgccgccaaccggccctcgggggagacgggtcccgggggcgcaggcgcgggccccagacacagcgagctccagagagagcgcagcgccgagcctggcagctctggctccagcaggaagacgcagcccacggccagcgccaggaagcccgcgtacgcggagccgcgccacagcgccatggggacccaggcgccgcacctgcgcgaaccaactcctttcctagcccgcgcctcttccgggctcggcgcgcgccgatgtcgacacaagcgctacgtcacaagggtgcgccacggggccccccaaggggcggggcgacgggcggcgccaggacggagcgaggggggaccccacgcctcagtcccaggcctggcactgcggtgttgccgccccggaggaggtgggacaacggcggttgtgccagtccgggcgctgcacccccttcccggaactctaatcgtatccccaaatagagggatgggaacacatttgctttcgcagtaaaacgaaacggacagattgtgaagaagcggacaaacctcgcgttaatattcgaaccagtgggtgtccccattggcacggatcacacccccatcttttaatccctccctccgcccgtgtcccctcatttgctagacttgtcctcttccaggcctagtgctcggcgcttctgagaggaataggctcacagaatagcggcgctgccgagacccctggggtacgcgaggcagggggattccgcccctttggaaggtggccgagaccctcagccactaaaggacttcgtcgagacaggagagcccgcagagatcgttctcttctggataaccagattattccacaatcaaactttaacccttttgggggcgctgttccctttaacaaactctggaaaatgtacacaatcttgtgcacaacacgagagttatggacctgggttgagaaacgctgctttcttttgttcccccttggtgacatcacttaaacccagccctctcttcgctgatacttttctgtgcatgaggctaggttgagagacagtgaagctaggctgggtaccagctcattctcatcagccacaatgcccggcctagtcttgttccctggtttgtttccacttttccaattctctcggctcctgaccttggctttgtgtccagttttccactgtgaccctgacctttggacttggcagcgaaactttatttccctaactttgatcttgggcattagtcttcattctcctcagccccacctcatcagaacttccccatcctggtcatctaccttcccgcagttcatcctacccagcctacctgaccatgccatccctttcgacaaagatattcacacaggaacagatttgggctaccttggaaaagaagccaaagagccagtcagatctttatgaagccatgaaagccatcttccctagagttgcctgtcacttctctctccttagggagacatgtcagtcagttcctagagaaactgcttcttctcacaaccctcagctgtcaggtttccctggcacccagaggggactgagccagcagctgacctgaaaacagcgagtctgctgactgtccagcgatcatttccctctattgagaattttaaccaagtttctgttgtctgtagttatttgatattggctgtggacccacaaagtcacacaaggctaaaggtcagaaccagttaaatatgtttccaaggtgaagttttggggagcacaggaagctgaactgtgggaaggtgatagaacagacagatctagaggactaggagagtgctccacattaaagtgatgtggacagaaacctgcctggggctttcttgctcccacgagaggctgctaaacttccagcactttgcacctaattcttctgcttctttctagatttgccagaattgttgatttagtcacagagacaaaacaacagcagttgaacaaagtggatgtttatttctcatgtaaaagtctaaatggggtgttggcatgttgtgggctgtggtagcaagcttggccccctctggttgctatgggacctgctgtgggcctcttgctggttagtcactcagtgtgggtttgcattgtgggtggtgaagggggccagacaaggaaacgagagagctgacctcaattccaactgagaactgaagagtcaggagccgcaggaggtgaagaacagaacaccagggacagttgccaggcctggcggagcctgatgtggcttctggtcacatacagagtcacagggcccttaattccttctcatcggggctcaggggcaggcattcactgtcttggtgccacagtccctcttgaaatatttccttaacgaaaatcagaaaagattctgatcatctatctgttcagagagtctggaatcctttgcaagccaattgtttttctagaagttaggtttctggggacaattaaaacagctctgagtgggcagctgtggctcctttgcctaggctgaacaaagaggaaagggctgggctgggcaggcctcaagacaccccccgcccccacccaaattgcttccagacatggcctttcctattggttctctctcctaggaccttgaaatgagagaagaaaagcaatttggttctagaaaattcagaggcaaatggaggctccaggtgccccacccaagatcctgacctggaaggccagggagcagatcctgtatgaacacaaagaattagcagaatcctgtcagcttccaaattagctgaaggttttggctttaacataaatacccatcagcgtcacccccgcaatctgaaaggccttaaggggcacatttgttcccacgtggagcagaaactaaagtgggaccaaatggtccctgtgaaagctgggctaacccactttccttgcagctccaggcctctggggtttcatccaagctgctctttgaaggccacactgtgtcaaagcctttgttgatgccagggacacagcccaccacaggccatgcccaaaggccagagtcagagcacaattttgaagattacagaaaactccaaagagattgaagagatggaataaaggatcccagcccccgaaaagagaaagctttgtgtctgtagccatagcccttggcaatcagacatcctcctcactaatgtgaggtcaggaggggactagaagtgctcagaggatggactgcctctggccagtgcaggggagaggcaggggtgttgaggcacaggagccagatgagaggaacgtcagcagcaaagcagtaagaagaacatgagagtttcttgatagtaatagaacttcctacacagactgggaaccgggttgtagcttgaggggatgtgacaacatagtggcccggaattttcactttggaaattaactgctttggaccaggaagaagcgctgagcctagaaaggcaggaggcacaggactgtgtgggcttctgtctggcagggacctatgagcttcatagggcgaatgaatcggggcaggataaagcagaggcctccaccctcacagtgctcttagccatctcaggcttcccggaacactgctaccaggctgcctgctggagccctttacactcacaggccttcctgcttgggttctcttctgcaggctgcgtaaaccagtcctgttgtagcccttgtagcatctgctgtagtgatctggtttgggtttcagtattacttgcaatggtttggaaggaaatgggaagtttgccttctaactacattttctttttgattcaagaaccctagcagttctacaaccactgggcctaaaactaaaataaaggaaaaataaataaaaggaagcaaaaacatctaactgggatggcctggcagcattgccagagagagtcctcaggggcccatgcttgttctgtcttttgctctgccatccctagggtggacagcacggaagaggcagtacatcttaacaaaatcagggttctggatgaagggaggggtggtgaatggttgctgcaatcaacagttcatacttcaatggaaagaaggtgggatttgattcctggctgcaaatcttcactctgtcacctgctatctgtgtgccctcaggtaagtcatttaacttttctgttcttcagtttccttatatgcaaaataattcctactttgcagaatggttgtgggaggtagagttatcttaagacagtctagcacagtgtctgctacatgctggaattcaaaacattccctgctgttgctatggttggttctgagagctatatttaattttctttttagtctttcttgctggtctgtcactctcttactataaggaagacagccatttctgcataggtcactatgcagtagccttttctattttttgacggcttagcatctatgtaatatcccactgaatgaaaatactaaaatttatctattgtactatgaatagacgatttggagttttcccagtttttttactattacatacagtgttgctatgtatatgctgtggtacacgtgtatagccatttcttcagggtagaaacaaagtaacatttctgggtcatatgatatgcctgtcttcaactttactatataatatctgacatctttccaaagtggtatgccagtttatcttcccactggcagcatatgagaatttctgttgctccagctacactccaacagattcttaaagctttgtcattttgtagggtgtgtagtggtatcttactgtggttttgacaagtttccatttgttggttatttgcaagtatcttgcctccctcccagtcacttgtctattcattctttttataatatctttagtgagtagagttctatgaaaaattattcttatttatgtatttttgtagagatagggtctctctgtgttgcccaggatggttttgaattcctgacctcgagagatcctcctgccttggcctcccaaggtgctaggaatacagttgtgagctaccatgcgcaggcttaaagttcttcgtttttagtgtagttaccgttttgttctttttttattactactttccccttatcattggtgctttttgttacttatttaaaaaatcttcccatactcaggatcgtgatggtattttcctgtacaaccttctaagagctgtaggctttcacatttcatgtttaggtatttaatctaccttggaattgatttttgtgtgttgtgagaagaatgcttatagatacccaattgacccagtgccttttactggtcatttctcaatgactctgcattcccacctctgtccaataccacgtgtctatgtatgtgtggatctgttttggggctcttcaatctgttccattggtctatttgtttatcagcgtctcactgtcttgatatctgttaatataaattctttctccttactcttcaagagtgtcttggctatctttggccttttaaaattcccatatacatttttgaatcaacttgtcgccctccctcccaaaaaaacccaattaggatttttatcattctaggactatggtagatcccttcatttatttagatctacctaaatgtctcccaatatcatattagactttttgtggaggatttgtatgtctttagtaagttttattactaggcacttaatatttttagtatgcttattgaagtaaaattgatatgcattaagtgcataatatttaaagtatacaaattaataagtttaatatatgtatacaccctgaaactgttacaggaaaggggtccagatccagacgccaagagagggttcttggatctcatgcaagaaaggattcagggctagtctgtagtgcaaagcgaaagcaagtttattaagaaagcaaagtggtgaaaggactgctactccatagacagagcgggacgttcccgaaactaagaggaggaacgcatccaccctaggtacaatgcttgtatatatggagagatgtgctctgctacaagggtttgtgataaactattaattttcttaattatcgtatttggcaagaatcaatattattatctttcaagcaaaattaggaatgcctttgttccccagatattgggatatctggacactcccgagtctgggtctgttttagtaaacattattaatttgttcccttaaccgtaaacatctagaggctaagaatgcctaactttctgggaattcagtccagcaagtctcagcctcattctcctagccctcactcaaagtggagtcgctctggttcgaatgcctctgacaaaaccatcaccacaatcaaggtaatatagtaaacatatccatcacccccaaatacttcctcatggccctttgtaacccttccctcttactccttcctgcctgtacatcctcccactccctgtacctaggcaatctgctttctgtccctacagttcagtttacactttgcagaattttatataaatgggatcatacagtacatactctttttgatgtggcttttttcatacagcataattatttttgagatttatctaggttatagtgaatatcaactgttaattgctctttaaaaaacttttaacttcaaaacagttatatattcacaggaagttgccaaaatggtagggtctgtgtacccttcacccagtttctttcaatggatatatcttacataatcatagtgcagcatcaaaaccagtaaacggacattggtgcaaggtgtatgtatagttttgtgccgtcttattatatatggagattcgggtaatcaccactcaatcaagttgcaagaactgtcccatcaccacgaagatctccctcatgctatccctttagtcacacccaacccccatcctctaccattcctagaccctggcagccactaatctgctttgcatcactgtaattttgtcattctgagaaatgttataaatggaatcatacagtatgtgatcttttgagagcataatacccttgagatgcatccaacactgttgcatgtgtcaatagttcatttttgttatttatttttattttttgactgagtaatgttctgtggtatggaaagatcacagttagcttagtcattcactcattgaaggagaactccccaacaattgctctggacatgctggaattttttttttctgttctttgttcattcttgctcatggtgtgttacaaatatcataattctcctttttctctgtgaccttgtctctcagtctcccatcaaggagtgatgtctatttctccacttcttgaatctgggctggccttgccaatagaatatggcagaagtgacatcgttccatttctgagtcaaagcctgagttgttgccagttttgggcaattggttgttgccagttttgggcaattgcaaataaagctgcaataaacaatcatgtacagagtattgggtgcacatatttcatatctctgagagaaacgcccaggaatacaattgctgggttttatgtttagttttcttttacatccccacaggcagcatatgagagatccagtttcttcacatcctcaccagcacttgatattgtcactaatttaggttttgttctaatgggtgtatagtgacatctgtttgtggtcttagtttacattgccctaatggctagtagtgttgagcatctcttcatgtatttatttgccatccatatatcttcctcagtgaagtgtctcttcaggtttttttttttcttttttgagacagaggctcgccctgttgcccaggctggagtgcagtggtgtgatctcggctcactgcaacctctgcctcctgggttcaagcgattctccagcctcagccttccaagtagctgggactatctgtgcgcaccaccacacccggctaatttttgtattttttagtagagacggggtttcatcatgttggccagtctggtcttgaactcctgacctcaagtgatccgcctgcctccgcctcccaaagtgctgggattataggcatgagctaccgtggctggctgtctcttcaagccttttgcccattttataattgaattgtttgttttttgttattgaattttgagactatatatcatatattatagataaaagtcctttgccagatacatggtatgcaatattttcttccagtcttttcatcctcttaatagagcctttcacagaataaaagtttttcttcttgatgaagtgtaatgtgttgattattttttcttctatagattgtgctagtttattgctttttgttgctgaatagtattccattgtatggatataccattatttgtttatctattcatttgttgatggacattgggttctttctagtttttgactattacaaataaagttgctatgagcatttgtttacaggtctttttgtaggctttaattgctcttgggaaatatctaggaatggaatacctgaatcatgtaacagatgtatgttccactttttaacaaactatcaaattgttttccaaagtggttgtaccgttttatatacctaccagcattctattagagttctagttcttctgtttgcttgccaagacttggtacggtaagtcttttaaatttagccattctaataaatatgtaggtatatctttgtcttaatttttattttcctaatgactaatgatgttgagcatcttttcatatcttcattggtcaagtatctgttcatatcttttgcccatttttattagattgtttttttcttattactgaattaaaaaaatactctggatgcgagtcctttataagacctgtgatttgcaaatattttcttgtctgtcttttcattcccttacctgttatattggattagtggccaccctactgacctcatttaaacttagttacctttttaaagactgtacagtcacattttgaggtactagggattaggacttcaatatatgaattttgaagggaatacagttcagcccataacactccccaacaattgctctggacatgctggaattttttttttctgttctttgttcattcttgctcatggtgtgttacaagtatcataattctccttttctctgtgaccttgtctctcagtctcccatcaaggagtgatgtctgtttctccacttcttgaatctgggctggccttgccaatagcatatggcagaagtgacatcgttccatttctgagtcaaagcctgaggaggccttgcatgcttctactctctcttgcaaccctgcactgccacatatcaacaagacttatcaacaagcctgggatagcctgctagatgatgaaagaaatatggcccgcttgctcccatcactccagctgatagccaggcaaccctaagaagcaaagtcacctagctgattagtagctgaccactgacacaaaagtaagatcatctgagaccagaagacagcccatctgagctcagcccaaattactgacccacaaagtaataataaataaatggttattatttttatgtcactgaattttgaagtggtttattattgaacaaaagctacctgatacccatcttttttttttttttttttgatatggagtctcccactgttgcccaggctggagtgcaatggcgtgatctcggctgactccaccctccgcctcctgggttcacgcaattcttctgtctcagcctcctgagtagctgggattacaggcgcccaccaccacactggctaattttttgtattttcagtagagacggggtttcactatgttggccagactggtcttgaacttctgacctcatgatccgcccacctcaacctcctaaagtgttgggattacaggcatgagccaccgcaccaggcctacccttcctaagagtctttgctctggctcttactttcatctggaatactctgtgacttgatctttgcatgcctggctgctttatgtcattcatatctctgctcaaatacaatttcctcaaaaagggctacactgaccaatcaatataataagcctgtaggtctctacggcttctccctatttatttgtttatttttagagatgaggtctcactctgttacccaggctggagtgcagtggcatcatcatagctcactgcagcctcaaactccaaacacttgggctcaagcaatcctccctcctcagccttctgaatagctgggactacaggtgcatgccaccttgactggctaatgttttttttttaatttttttttagagaagggggtctcactatgttgcccacactagtcttgaacccctggcctcaagcaatctcctacctcagcctcctgggtagctgggattacaggtgtgagccacaatgcccagccatttttttttttcttacacagaaaagctccaatattcacttagatactgcagaaggaaaagagaggctgaaagggttggatcaaggaagtaggaaagggaatttctggggcatttccttcccccaatcccagaatagccacagaaatcacagtcaccaagagctgctgcttctgaataacatgacagtgatggtaaattttccaaaatgttgattgtaacagagtttgccacatgaccaaactggtggatcatagagtggacagacatcaggagctctggaaaaaaaattgctactcagtacctactcaagttgtaatggggagagaaatggactgatatgccggatttttgttgcagagagctggcaaacttgcagtaagtaactagctgcattcaaactgactgacgcacatagatggagccctgaaatccatagctccgttgaagaggcagcagaatttatctactccgacccaggtttgcggaatttatcaactccaacccaggtgctaggctgcttgtggtagggagtgaagccatcatgctgatggatttggtggtgacaaagcaggctgtcaggaagaagtaggtcccccagattctcccgggcaaggggacaacactggaaactacatgtggtagtttccagtatgttaggcttttccttctgaaacttggcaaagtagaatttgctgaaaagtaagcagtatagcttgtttttaatttcgtttctcaagaaaacccagctaagtctcatcatgactgtttactcttgtttcttttgggaaattaacttcttaatataactttgactaaagatatgtagatttgtggtatgaaaagaaaatctatctgttggatgatgttcccagtgaagtactatccatttgttattttaaaagttattctcttttgttctaaacagtaaatagtgccaaaactaagaaaaacatgtattatagtttcaacgtcaggctgacttgcctgcagatctgttcgcaatagactgtaatgcccctttaaagaaagatttagaaataaattattaaaagtattaattcatttaaaaaaatgtaagcatgaatggggacaagctggggagaatgatttgtctgctctttctgggagggtggcgagcaacatccatgagaaacctgcaggccttgccactgctgctgagagccagtgaccccaagggctgaccacttgggatgttagctgcttctagtccaggcactgtggtctgggcctgtggtataaagaagggctattgccataaaaggagatagacacaaccagcttcagttcatcctgcttcctgtctcagaattttttttttttttttttgagatggagttttgctcttgttgcccaggctggagtgcaatgaatagcgtgatcttggctcactgcaacctctgcctcccaggttcaagcgattctcctgcctcagcctcccaagtagctgggattacaggcacctgccaccacgcccagctaatttttgtatttttagtagagacggggtttcaccacattggccaggctggtctcaaactcctgacctcgtgatctgcccaccttggcctcccaacagaatttttttaaaaaagaaatatggtatgtctttggaaacccgagattcaaatcttagcaccctatatccccaccaccactaccattaacagtgcagtttggagcaagttgcttaatcttttccagcccagtttcccatttgtaaaatggaaagaatgacatccatataatgtagttgctggaggattcattattttattattcaacaattgtttattgagtgccagacattagtctagtcactaagacagacaaggtccatgttctcatggaattcatattctaacagggtaaggtcacaacaaataaataataaacaaatgaaaaatatcagatattgataagttttagacagaaaataaaatagggagctgggcatggtggctcctttctaatcccaaaatgagagaattgcttaagctcaggagttcgagaccaaactgggcaacagggcaaaacctcgtttctacaaaaatacaaaaattagctgtcccagctacttagaaggctgaggtgggaggatcatttgagcgcgggaggtcaaggctgcagtgagcttgatcacaccactgcacttgatcagcgtgggtgacagagtgagaccttgtcaaacaaaacaaaacaacaaaacaaacacaaaacaatacagattcactgtataatattatttagaaaatgcagaaaggtacaaatacttattttataataactcttaatcttaatattcaagtttttggtgtatatctttgcagagttttaaaaaaatgtgtgcacacacatgcgtcttcacagaaatggaactttgttattgtatatgctgcattgtaacctgcttatttgcttaacaatagaatggcgtctttaatatatccaaactttttacccagaatgatttttcatggctgcgtagaataccatttatttaaccaagcggtagagagttagactattcacaagttttgctattatgaacaactagggagaagcacttacacagcaaaatctgctgagtttctgaattgtctccttagtatagaccacgcaagtgaaactatcagatcccagggcgctcccgtgcggttgtcagatttccctcctgtaaagtggatgagtaaccccaccccacatgcactcccgtccacacagctcttgaaaggccaaaccaggcgacgctgtggcccagagagaaccagaagagagggtgcgtggggtgcacggcaagccattgagtctgtggccacacctaggcggagagagacgagctcgggtgagggtgggccgcgggatccacagactcctcttcgtgcggtggatgcatcaggctccgtctctgaacctcggtttccccatctgcagaatggggatgggatctcctggtgatggggatctgtggacgcggcgccctcgggggtgcacagaactaaggccggcctgcagcagcgacctcgggggctggtggggacggaagaccggacctcctggcccgaaggctgggcgcagcccccgcccgcccgcctcttcccgccggcgcctccccggggtggcagtgtggggagagtggcttggcgcccgcagggggcgccgcgagcccaccgcgagagcggccgcggcgcggggtgggtgccgaacgggctgcgcgccgcgctgctcccgacccgcgggtcaagtctggcgcctgggaggtccttgaattccgcgggatttgtttttccgcaaaaccaaaaacgccatccacttaacagatccgtgctaggaggccctggctcagtccttccaccaaacacctcggcccagccgcggctgtacggctcccaggctcccagtgtttcctccacgctttcaaacctcagcgctgaggtgaccgcctccgggcagccttcccggactaccccaggacttgggggcgtggctccacagcgggcctagttccgcccgtgtgctggcctcttccacgaccggcagtctttgaggatggggcttggcctccatccccttgaacccctcagcgtcgcaccccagagccactctgacccctggccaatgattataagtgagggagccacctcttctccctgcgtggcacaggccagggtccgcaggaaggggccttgctcatccccaatcttaagctccgctgagatgaaggaaccaagagcaggcttggcactgggagggcggctgtcccagtggcggggaggggagctctggatctgtgggggagtttgtgcagcgtgtcagcggggggtggggtggggggggtgggggcctgtggatgcccgcaggtgtttgtgtttgtgcatgtgtaagtctctgtgtgtatatatttgtgggaaagcatcttctaaattaagaatatatttgtgtagggtaaatggtcaagtcaaatagaaagtgacttcaatacttgttacttgatggtataaatacaatagccaaggaattcagtccagaagctcacatttgagggttagggattggtgctgtatttgttacaacaggcgtctaaccttggtcaaatctcttcctcatagtcttcattgtctctggtttgtttgtttgtttttctggtttgttaaatgatccttttttttttttccccgagacagggtctcactttgtctcccaggctggagtgcagtggcgcaatcaccactcactgcagcctcacctaccgggctcaagtgatcatcccacctcagcctctccagtagctgcgaccacaggcacgtgccactaaatgattattttttcaagggagaaatcatgcctgtcatacaaataaaaaatgaacaagtgtaaaagattttatttaactcattagttaatgaagttaaaaactgattcaaaggacaacacaaaggccagatacacacactggcatcagaaataatgaaataagtttgttaattgatacaaaactggcttcatccacagtgtgtgtgtgtgtgtgtgtgtgtgtgtgtgtgtgtgtgtttggcggggggtggggtggggggtgggggatcacttgcatctccacctgacaaaacttgtttgcattgccatggacaataataatttgtattattttcagttttctacagtttacagattcaaagacaatgaaaaatggagactaccatagaatgacataacctggaagggcacaccaggcctgcattccatagggtacattttctccccatttcaaaagtctttcacaatttttcctggccacttatacaacaggcttgagttgcataaaggtttttcaaactttttagtggcggaactctctttctaagtgaaatgtaacagcaaaccctaatatctatctatatatctaatagatagatactttattttttaatttttaattttctattttttgagataggatctcactctgtcgcccaggttggagtgcagtggcatgatctcagctgactgcagccttgacctccccaaactcagatgatcctcccaccttagcctgccaggtagctgggagtacaggtgcatggcaccacacccagaaataatttttgtattttttgtggagatggcgtttcgccatgtggcctaggctggcctagaactcctgagttcaagctatctgcccaccttggcctcccaaagtgctggaattacaggcgtaagccactgcacttgacccgaatatattttttttaacatctcagagggttaaaataatgtattatacagttaatatatgcttaccgtaaagatgtcaaatagtacagaaagttaagtgaaacatttgtttcccttcccttgccctttctccctgtccccttctcattctccagagccacctactttaacagtttcttatgtacccgatagacactctatggatatatacaaacatatacatatattttttgagacagggtctggctctgtcacccaggctggagtgtagtggcccaatctccgctcattgcaacctctacctcctgggctcaagctatccttccacctcagcctcccgagtagttgggattacaggtacacaccaccgcacctggctaatttttggggtttcaccatgttgcctaggctggtctagaactcctgggctcaagtgatcctcccaaagtgatgagattacaggcgtgagctgctgcacatagcaaacacacacacacacatacacacacacaaagacacacatacacacgcgcgctcgcgcgcacacacacacacacacacacacacatatatatatatatatttttttttttttttgagatggagtcttgctctgtcgcccaggctggagtgcaatggtgtgatctcggctcactgcagtctccacttccctggttcaagcaattctcctgcctcagcctcctgagtagctgagattacaggcacccaccaccacgcctggctaattttttgtatttttagtagcgatggggtttcaccatattggccaggctgatctcgaactcctgacctcaagtgatccacccaccttggtctcccaaagtgctgggattataggcatgagccaccacgcccagctgcaaacatatatttttaaaaacacaaacaggataaaatacattgtggatatcttctgatgtcagaacatagaggtccacctcagcattttaagtgattaagagtgttccatggtatggctgccccttaacttatttggctaggcttctattaacagactttttttagttgtttctaattttatggtaatataaacaaatgctacaatgaacctccttaatcagtattgtgtgtgtgtgtgtgtgtgtgtgtgtgtttgtgtaaactttttaggagtggaatcattaggtttaagggtagctgcatttaacattttgatatatcttgctgagctctcttccctggaattgcaatcatttactttttctgctacatgctgtatctttacacccccgcctacgttgtgtattatcaaacttctaaatcttagccagtctgatagagggaaaatgacacctcataatttcagtgtacttttctacaattatctctagctgttacaatattccctttggtgggaaattgcttcattattttctgtgacttccctttgcagaaaaactcacgcggcatagttcgaaaacccttgatcttgacagattccctgagctctcatattccaggaggcagattctctgcaagtgtgtgtttgtctccgctctgtgtcagtgtgtagcttgtgtgccacctctgtgtgtgtgatgtgtgtctgactgccgatgttcatgttagtgagtgtttacctttcccttccttgaggatcagagacctactcaggagagcccaggttaccaagaagtttactgtaggatacagagatctctcccagttgggaaaagaagagcaactggattttctgtaaccaagaactgcatatgggaaagggatagaggacagaggctgccttctctctgcggacccataaacttgcccatgggccgaagccagccaccctggtctgactctgcatgcctttcagctgaaggaacaattgctgcctgcaacagtcattcagtttcccaaggaatcaacctctctgtgtgactggggaaaaggaaacagacatcaagaggtctgctggcaggggctgatgcaaggattgtaaatctctgcttcatcacatgtgcattatttgggaagtggctggaagttcaattcatgcatctactggcagtgcatctaggggaaagagcgggaacacaggaagaggaacaggctgtttcatccttaattctgccacttactggctatgtgtccaagggcaagctgcttaatttttctgtacctcattcccttatctgtaaatcaagggaaacaacgcccacatcatgaagtcattgtgatgagtaaattaaacaatacgtatcatggatcttaataagcgtctcagtcaacacagaagttccctctcttaagggtgacgttttgataatgacaccttttcaaaatgaggatctcaaagaacatccccaaacattagaggaggagggagtcttttttcctttagtgtgtccattcagcagcagccttgtgcctgtgtaccaccgtgagaatggcaaagtccagtcctgcctgccctcctgtgccactcacggccacacgtttttaattttcaccacactcatgcaatctcctgcacacatcgtgatacttcgtgcctccgtacctttgcttgtgcagctcctgcagcctggaatgttctctcccactccactgtacctggcaaatgctcacttatacctcaaaacatatcaggacaaaggacatagtatttagtctaacacatctggctgtttgcctggaagagaaccagagtgaacccctatctctagccatatacaaagataaaattccagagggattaagggcttaaaaatgtaaaaaataaaatgttaactatctgtcaagacaagccacaatgcaacattagcgtgtacctgccagagtagctaaaatgcaaacgtcagatgatagaaagtattggggtgggtgtagagcagctagaagtctcttacattactggtgagagtgtaattgataacggccactttggatgactggcaatatccacaaaagctgaacatacacgttctctatgacccaaaaattacactcttgggtaaatactcaacagaaatgcagacataaattcaccaaagaaagtttgcaagaatgttcatagcagcactatttgtaatagccccaaattggaagcaacccaaacgtctatcaacagtaaaacataaagtgtggtatgttacatacaggactgctgcacagcaacgagaatgaatgaactacatgaattcatctcacaaacataatgctgagtcaaagaagctagatacaaaagagtacacatggatatttcatttaaataatgttcaaacactaacctacgatgttagaagtcagggtagaggttaatctttgaggacggttgtgactggcaagggggtgtgaactgaaggaatgtctagggtactggtaagattctgtttcctgatttcagtcctggctacatgagtgtgttcacctcgtgaaaatttattgatccataaaaagatgtgcattatttcatacatatatctcaataaaaattttggcaaggaggcatcatataatctaaggttagaataccttctcaaccaaggttggaaacctagaagatgaaaaaggtatttttgcatatatatacatatacatacacacacatatatatagcatttttgtgggaaaagatactgtaagcaatgtcaaaagacaagcagacttggaaaaagtgtaatgcagatgatggacaaaggctaatacctatagtatgcaaaaaactcttataaattgatgcgaaaagacaaacaatccaataatgaaataggcaaaatgatatgagtaggtgattcaaagaagaaaaatatccaactgatggaaagatgctcagattcattagaattcagttgaatgcaaattaaagtagtaataagatactcatttatgctcttcaggctggcaaaattaaaaagagtttctataggtattgtgtgtgaggttgtggggagcatgctctcattcattgctggtggagatgtaaattattacagcctttttgcaatcaatctggaaaaatccattagaattaaaaatacatatatcctttgacctagtgatcccactcctgggaatctattccacagaaatagaaggatccacctaagggtccatgtagaagggtggttattgcagcattgattgcagaggtgcattcgtggtgtgcatgcatgcacacacatgcacacacacagaaaacaaagcctgtgcctctcagcagggaaatggtataaatggtggtactttcccttgaggctcacagtctagagggctggggtaaactcttgctggttcacaggaggtcttcacatctggagggggtggtctgggagtggggtgggcagagtcatggatgatgagaagccctcttcctcctagcctgagctagtagcattgattccagagcaggctttggagaagtgactatttagagttcagacattcccatgtcccctcttggcgggactcagttcctatccctccagtatcaaagaagtgacatcaacaaaggatcacagaggtagctcttattgacacccactgcgggtctcatttaaaatggctttcttaagccaaaggcaggcaaatatctctactaactgaagaacaaaggagacatggaatcaattgcaaataattatttctaaaaatcatgcctctcttctgaagtttgtgtttgtcatatctctgtctacctaaaaattgctctctcttaggtgaattaaaatatagagtcaattccctaacattcggtcagttgttgggcagccctggcctagcttaggaaggtagccctaagcaggcctttaacactaagtgaaagcccccgtagcatatgtataaatatttaaaatcataaactaggccaataaactattagataaaaagttccatctttctgtcttgaaaaatatgccctcttaagatcaaaatttttaaaaagtatagcactacgatttttatatgaacaaaaattggtaaaatagtaaagatgacagaatttaattatgtgtgcatctatttggatattctgttgatgggctggtgatgttttggtaagttataaagtcagcatataccaaatttatattgtaaatcattcaaattattatttatcttttcattagatttgtttttcttaccttccttattgcaaaattacctaattatgttgttataatcaagatttttgcacaatttgtgttttattgatgatgacgccaaattagactaccttttttgagttgtaattcttagataattaaaaaaattaatttcaatttggagaaagtttcaggaataaatggaattttcattaaaatcttaaaacgatgtttacatttggaaatgaaccatgaattttacatatcctgttcaaatactttagtagagttgtgttaggtaaactgtaattattgcagaaaatactacaaaatattttaacttcataatagaaatttctatcatactgcaatttttgctatcttttaaggtaatagtttatgcactaacatgaagaatagcttcgtacatattacatctacacttatacctctactgatttgaaggtaaaataaagtgttcatattgcacacatgttcctcagccactgtacaacaatcaataccacactaattcatgagacctcctgaaccacgaactggagcacaaagagaaacatgaaaatggacgtgtggccctactgggaaatggtatttcactgtgcaagaaacgattgcgttcttgctatcagagataaaggatttgacaagctaataaatttgtcttttcccttacctaagtgcttccgccactcaaatcctccctgttctctgaagcagtgtctgtctccaatattggcggaagcacaacccagaaacctccgtgacgttcagacatggttgctttctgttttgaggacacagggcaaaaggtgaggagccgcatttccctgggacctgaccggtgttgtcattggaactgacgtttctgttgccagcagcgctatgccagcgctgagcactcgatcccatgtgctccataaccaatacattttatgggtgtttgtgatatatgcaaccttttcaagtagggcttcttagtttctaattattagtttttaatttcccaacccaatacagatcaattatttgattcaataattcactagaaataattcactagaaaaatgaaattaaaaaaaatctatatgaggacctgtggggtgactcacgcctgtcccagtactttgggaggctgaggtgggtggatgatttgaggtcaggagtttgagaccagcctggccaatatggtgaaaccccatctctactaaaaatacaaaaattagccaggcgtggtggtgggttcctgtaatcacagctactcgggaggctgaggtaggagaaacgcttgaacccaggaggctgctgcagtgagccaggatcacaccactgccctccagcctgggcgatagagtgagactctgtctcaaaaaaaaaaaaaaaaaaaaatctatacaagttacaagccccaagttttaaagattcaacagatataaccttactgttagtttctgtgtgtaactcatcaagaacaagtaacagaccacgtgtgggctggcactggtccaccgaccacacttctctgtggaggactgcttcgagtcactggagtcaccagattcagggtagggaccccctcttgcctctgtctaagagtggtgccggtaaccacgaggctgaatcctgccccacagtctttttcagtctctgtgtgagcacttttgcctgtgccatgcagctctcatttcacgccaagttctctgttctcttactgtcctgatacaagtctagctccccacggccccttcatttccaccagccttgcagccccttctccttcctgagggccccatatcagtgtatgatgaggggccttgaatgcatgccgagaaaggaagcttctgagctgggggtcaactctgagaatgtgatgtggcctttcacccagccaggacctctcctgggctaagctgtcagcaccagggagtccacgtacagctgatgcctccctgcggtgggggaacagaaaggatggggcagctccccagaaggccttgggatttcttagcagagataggaactcccattcacactctgccaggggtcagcagcagttctagagcttaccacgtgctcccaggaaatcatacatgtttctaaaatcatccatgtatcttttttttgtcacctacattttttatttatttatttatttttatttatttatttatttatttatttattttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatgtaaccctgagtggacacagcacatgtttcagagagcacagggttgggggtaaggtcacagatcaacaggatcccaaggcagaagaatttttcttagtaccgaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagatggggtggtggccgggcagaggggctcctcacttcccagtaggggcggccgggcagaggcgcccctcacctcctggacggggcggctggccgggcggggggctgacccccccacctccctcccggacggggcggctggctgggcagaggggctcctcacttcccagtaggggcggctgggcagaggcgcccctcacctcccagacggggcggctggccgggcagggggctggccccccacctccctcctagacggggcggctggcagggcagaggggctcctcacttcccagtaggggcggccgggcagaggcgcccctcacctcccggacgaggcggctggccgggcggggggctgacccccccacctccctcccggacggggtggctgccgggcggagacgctcctcacttcccagagggggtggctgccgggcggaggggctcctcacttctcagacggggcagttgccaggcggagggtctcctcacttctcagacggggcggctgggcagagacactcctcacctcccagacggggtcgcggccgggcagaggcgctcctcacatcccagatggggtggcggggcagaggcgctccccacatctcagaggatgggaggccgggcagagacgcttctcacttcctagatgggatggcagtggggaagaggcgctcctcacttcctagatgggatggcggccgggcagagacgctcctcactttccagactgggcagccaggcagaggggctcctcacgtcccagacgatgggcggccaggcagagacactcctcacttcccagacagggtggcggctgggcagaggctgcactcggcactttggggggccaaggcaggcggctgggtggtggaggttgtagcgagccgagatcacgccactgcactccagcctgggcaccattgagcactgagtgaaccagactctgtctgcaatcccagcacctcgggaggccgaggctggcggatcactcgcggttaggagctggagaccagcccggccaacacagcgaaatcccgtctccaccaaaaaaatacgaaaaccagtcaggcgtggcggcgcgcgcctgcaatcgcaggcacttggcaggctgaggcaggagaatcaggcagggaggttgcagtgagccgagatggcagcagtacagtccagctttggctcggcatcagagggagaccgtggaaagagagggagagggagaccgtggggagagggagagggagagggagggggagggggagagggagagggagagggactcacctacattttttaaggacccaattccaatttcctgcccttatcatctctccttctcattgatatttttccagtagatgtagctttactcattaccaactactgccaattcacttaagctttcacctttaatgttttaaaataacaagggaattcagaagtatagaatgtggaagtctgccttcatcatcctcacaggcctgtgctcctcaatcccatttccatgagttaaggacttttagcaactattaacagcatgtccttcccagttcttgcctacacatttcaaaacacctatctctctcatcactcaaactgggggagcaggatcatgagcagccctgtggagaggcccaagtggaggggaattgaagactctggccagccaccatgtgagtgtttggaagcaggtcctccagcctcagctggagtttctcacggcaaccttttgagaaactgagtcaggactgctctgaagcattcgttaccctcagaaactatgagataataaatttaagctgctaagtttgggaggttctgtgttacatagcaatataatacaactttcatttctctccaatgaccgtgttagtttttagcccctctgtagcaaagcccctcaaaagagctgtctgtacacagcgtctccctttccaccctgttttctcccacccaatcccatctgttctaatatacattcactgaggtctgctccctgtgagactaggatgtgtagttaaaatgtcctcatgttccctgttgcagaccctgagatgaggattcttatgcaagcaatttgttgtggaagtgctcccgagagaaacagggcaaggaagcagggaagcaggacagggaaggggaggaagtcaggtaagggtgaaatttcaggcaaagtccaggtctcagaatgatcttgatggctctggagaaaaggacactttacagctatctgcatcctgctggtggggcagagactcagctactccccacaagcctggactccaagccactgctgcctactctcaccccaggccccgggagctttaacccacagccctcagttcaggtggcattaaagtgagcccttcctaggagtactgttgtcccttcctgaagtgaggctctgtctggggctgccccggtccataagacatatttttctgtactcaaggggacaagaatgataactgtgcttgtcccatagcaatgtgtggtgcaaactacactaaaggctagatactaaaggctcagcttaattctactgtcagcagctctcaggcccacccctgtggaaatagacattggagggagtgtgttacctgacacggatcagcatggcaccctcagcttactaacacagaaatggatgggtaggcttgaagagaaggggaagggtgtggttagcgccttttcccgcagtctgtgggaagccagctgccacccagccagcatgtcttatgacttattttagttttcagaactgcccttagacgattgaagcatgaacatcttttcctgtaaaaatggattattctacttccttgctttagtctgggactctgctcttgtggtctggtgagacttttgtacatgtggggcctgagaacacttttggtagagctgtctctgctgaggtcttcagaaggacctttgggcagcctcatgtctgtcttgggctgccaggacagaaatgcccaggtggcttctggaaggccttgtggccagagtgaacattcaagctgttcactcatcctcagcccaggccgcgcactgtgctcctcccagagctctgacattcgttcactatggaaaaggtgtgatgtagaaatacaatatttgttatttatgacccctcattgctttctaaagaaaatgaagtcccaggactatttgttgaaagtcatggaagggagaatacaaaattggaagcaaggtggggaagagttaaattgttctgcagaaggagagggaaatatatggggaggggtgggaagtagaggctgaagcttcctggaggaggatcaactgggaggggaatgcgcatggctggggagaaactttgtagggagagttacacaaaaatttagagtttgctgtgtgctatgcgatgtgatcctttactacatctctcctgttgacacttcagaacactatcagtttcttactcgaatgcattgtggactgggttttctttgaaggaacgaagaggaatgctgagtcttgcttcgaggttggtgaggtgtggatcagaggctcccagtggaagctgccaggcctaggttcagggttacatggagcactaggtacctgtatgctatgctctccagcctggccattcccttctttaaggaaaagaacatttcaggtagagggcacgaccagagaaaaaggtaagtttggagagggagagagaaaccagagtgggtggggaatgtatgtgagtctgttgggaaatggggtgaggaacagaggcagaaggtggtgctaataggtgaattagtccatccaggctgctgtaacaaagcaccatacactgagtggcttataaacaacagaaatttatttcttatggttctggagtctgggagtccaaggtcagggtaccagcatggttggtggctgaattcctacagtgggcccacttctggttgcagactactgacttctaattgtagtctcatactgtggagagcagagagaagcaagctctctcggggttcttataagggcactagtcccattcttgagagctccaccgtcttgaagtcacctaatcctaattatctctcaaaggccccacctccaaatactatgacactggggggtagggtttcaacacatgaattttgtggggacacaaacatcccgctcataacagtaggttaggactccaggtagggccttgcttatcttccacatcagaggtcctctcagctgtcctaccactcaaaatcttagggtaatccaaatacacctcaatgcaccatgtggcccaggcttgattcagtattgcattcaaagcaacacaattcaccttcactgtgcaattcatattgtctcttataatccattagcgtcttccaaatggaaccctcagttctatgggtaagaaggctcccacctgcaggggcaaccaccaccttaggaactgggcatggcactgggcaatcctaggctgctctggatggttcataaggcataccccagtggcagatggactggcactggggaaagtggtgtcctgttggctgcagggaggcatttcggacaacccactgcctctctgtacgttcttgctaaggtccccaaagaacttcctggcaaagacattttagaccttttaactacttggcaagtggcttacgagtccttctaaatacagcagattagtcaatggaaatacaaaactttagaagaaattcacggaaagagctattgaattggggaggttttgccggagtaggtattttctctatggaattctgatctgttcatttagtaatcctaattatggttttgctaatttggaggtaatttcagagaaagggttttattccactgggaactgtcaataggttaagaggattttgctttttcatttgtaatgtttcaaaggaatgtcattcttgcaacagcttcaactattttttgcttatgtctgccaccttgctgctcaaggttgacaagaaaatacctctgcttgttagctcccatggctggtttcttttataccagctgtgatctctctaccagctctcctagggaccagcagaagatatgtgcaaaggtgaatgtactgcattttccaggagtttccattctcttcattatcttcaaaaggatggccagactatcagagtagaggccaagccttcctgggcctttgggcctctgtgtacccagtgcctctgtgtaccccatgcctttacctaagaacactctctctccttcctcttaccaggctctttttattttattttattattttattttattattattattatttttgagacggagtctcgctctgttgcccaggctggagtgcaatggtgccatctcagctcactgcaatccctgcctcccgagttcaagcgattctcttacctcagcctcctgagtagctgggattacaggtgagcaccaccacacccagctgatttttttgtatttttagtaaagacggggttttgccatgttgaccaggctggtctcaaactcctgaccttagctgatccgcctgcctcagcctctcaaagtgctgggattacaggcgtgagccactgtgcccagccaccaggctctgtttaagtcatgcttgggttctcagctgcagctccctttcagaagtcttctctgaccccatgtcaatatccacagccatggactcttctctggggctccagacctgtgcactcattaatatcagacatttcattggatgtttcataggcacctcaaattcagcatgtcccaaaccaaatgcatcattgccctctcccttccaccttcatcccttccctctcttctcctctgaacctgcttcttcttccatgctctgtgtttccaggcagggcactattgggctatccttctaaatacagcagactagtcaccagaaccagaaacccaagggttacttcagaatcctccctctcccttaccctcacatctccctccattctactctattccgaaatccagtagatcccacttcttaaatctctctcagatcctttcttcccttttcttcctctccctggcctgggatgccatcctcatttgcttgaattactgtattggtgtcctaactggcctcactgcctctggtcttatctctcatcctggccactgtagtgatatctgatgtgaaccatgcagatcacaaaattatactccttgctctggcttctccactttccacaacatctctcccattggatatcatctaaattcccatctggtgactcctgacttgtctaacttcatcttctgtcagtttggaccagttaagatttctaacattgcaaggaagagaaaatccaactcaaattgacttaagcaaaaaggaaatatattggttcacacaactgaacatccagggaaagatgtggctcggtttcaggcatggctggatccaagggctcaagcagtgtcatcagaaagctgtttccatctctcagctctgctttttgctttgttagctcccattctctggcaggcttcttttcatgttgtggtgagatagctgccagcagctctagactgctacctcctcacaggaacaaatccagcagaaagagtatccctctcccattgctgctcaaaccaagtaccaggattacctttgcttggacctgattggcttgccttgggtcaggtgcgcaccccttaaacagtcacagtggtcagaggaaggcaatgctctggtaatccaggtctgaatcatcatatgctcatccctagagcaggttggaatcagcttttcccaaagcacatagactaagagtcggggagggcagctttccccagaaacaatggagaagtgactctaggagcaggtggaatggagaatgggctggccagcacaggcgagcaccgcaccctcccttcttgcaggaccgcccctcgtgccagctctctttccagctctccccactggctgactccttctctatcaagttgcaggcctatgtgctgcctccttggggcctccttccctagctccccagagacttggaggccccgcctcctgctgttcccagggtcctttgctttgcagcagtgatgctgctacattgtaactttttgtttgtttgtttgtttgtttgtttgagacagagtctcgctctgtcacccagtgtcatgatctcggctcactgcaacctccgcttcccaggttcaagtgattcttgtgcctcagcctccccagtagctaggattacaggcacgcaccaccaagcccagctaatttttgtatttttagtagagacggggtttcaccacgttggccaggctggtctcaaacacttgacctcaagtgatccgcccgccttggcatcccaaagtgctgggattacaggcatgagccaccacgccccgccgctacattgtaattttgggctttcatgcctctcccttctagactgtgagctccttgaagacagactctctctttatatttcggtattgcctgtatctggtacagggtctggcctagagtgggtccctattaagtgttgaatgagagaagttataaggagaatgtggatgtcacgtgggccctaatcctgcatgtcatcaaggtaggaagaatagccaggatcatggataacagaatgagaatccataaagagctcagtagcctggaaaaatggaccaaatctgtcaagaggaactgaaatagaactaactgtggagccctatattgaggtctaaaaagcatttgtttgggtatagggtggtggtggtaggagtatctggaaaagatgcttagttgtctttatgtggctacctaaaaatgctaagataatcttgggccacattaatgggaatatactgtttctccatatctctttactgtgtaaactctgattcttggcacaccaccatcgttagtccacacaatatccctttcttgttttgtttgtgtattccttttatctccattccattcccatatggaatacattctttttgtctgtatgccttcctatacttacaaagtttgtattgctgttgttttgaatttgtgtgaatggtgtggtgtcatggagcacattctatttcttatttttgtcatccagcattttgttgttaaatttccacttatgttgccatgagtataccaacttcattgcttctaaatgctgaatcccccctacgtgttacctatccatgctcctggtgatggacacccagattgctttcaatttcctgcaaccacaaacaattgtggtgaacattctcatacatgtgctttatgaatctgaatgagaatggaattgagatatatgctcaggtgaggatctgctggaacagaggctagtccatccttattttacctggcagtgctaggttgttgtcccaggtgggtgcactattcaacactctcacaagtggttagagttccattgttcccacaccctgctgccaatacttgttactcagcttctgtttttgccagtgtaacaggtatagtcatatttcactgttgttttcatttgcatttcttggattactgatgtggtttgcacattttttgcttttattagagaagggttttccctatgttgcccaggctggtctcaaactcctgagcttaagcaatccctccaactcatcctcccaaagtacagggattacaggagtgagccattgctccttgcctgattatattttcaaatgctactgagcctttgggttctctactccataaattgtttggtcattatcctttgctcattgttctattgagatgcctgtctttttgtattaattttcaggagttcttagaatttcctagatatcagtccctatctctacctggttttggacaaggcaaatacttttcaatggtcctgcttactctgatttgtctggtccgagaattgtgttgagttctgaggttcatatcttaaagagaccatgatgagcctgggacggagaatagacacttggtttatgaaactcatcaaggaggagctgtatcagtaagcgaaatttacaggggtgttgatttcaagcaatataaggaaggtatttccagtgattagagccaccgatgatagggtatactctctggagcagcaatgagcaccagaaacagcagcaggggtgcataaagagaagacagacagtgacttgttggggaggttgcagaaatgtttcccgcattagatggttcattccaaccttgatattttcagagcttttctgagtcaccatgtgttgaaagtcagagaaggaatcatggaagaggagaaggggaaaacacaactttaattccctttttcttctgcccttatgagctccccatagtcttcatttatcacacggtggcacttcattctgccttgtcctatacgtgagttacacacacacacagacatgcttgtgcacagccatgttcatacaatcactttcacattatgagacacacatacatgccatgtaagtacatagatacacaccaacatcgcaataaagcagtatatgcccccaaaacacacatggctatacacgtgtatgaaggaacagaaaagatgtgagatctttccttcaccatcataaggctcacagctgacacttctataacaaaagacaggttaacaagagaaaaacataacagatttgtttaatcaaagttttatgtgacatgagagacttcagaaatgaaaattccaaaatactgggaaaaacgatctatttttatgcttcggtttgatgaagctgggacagccatgtagaaataggattgtacagaaagggtatgatctcatgctaatagacttagtggggaaacccagcaaggcctgtctgtccagattcttgctgggcctctctgtgcagcatcgcctctcccaggtataggataggaccctttctggaataggggtcttatgactcccaaacaagttgtgtcagagaatttctttatggccagctgttacaccaaaaggtgtggggggaaggtaagagtaatagttttaggttttatgactggctttggggtaagggggttttggtttcttcaatgacccatctgggggaagagggcttttagtttctatggctggcctcaggagagaatgaggggcaagagacaggagggcaggggaatgtcacagagaaactttgctcctgaggcagcttctgaggtcttcactttggggcatcatttcctgagccccaacgtgttcatgtgccccatgcatgttgtgtgtgtttgcaaagtggagggagcggttctgggttaaatgtgaaaggccacacagtcctccatccttcttggtgtggaggctccattcgtggtggtccaatcctgccttcacttctgagagaacccagagcctgtgttctgcaggaaggtaaatatttgataatttacctcattccagaggctagaggcctgagcagggacaaggaaccggaacccttggttccaaactcccttcgctcccagcccagtgtcttcctggacttcccttcagtcttttctgatagagctaaataaaactctagaattggcctgtctcctcccaggaagaccgctttcagactattgcttcctaatgttgtagcatcttggtcattgagcttccaggccttgcacgaccctcaccctggcttggggctattctcctaagtgcatgtgaatgagatggtccaggaagcagagtgtctcagggttgggctgggggtgaggggactgcaaatctggccaatggaagctgtcttgtgggttgggggtaactctggggctggactggtctttttgatctttttgatcctgtacctctcaagagcttctggacagagtcaagcagctgagaaactgcctgctggacgtcggacttaaatacccaaggcaaggcagataacactatgcaccagtatcaatcacattgtctactgcaccttggccaatttccatcacttactcgagtccagtgaacaggacactctcacataacaagttacatggagcagggttattacttatagataggcagcaagggacaacagaaacctaggattcatggcgagccaatccccatggctcaggaaagaagcaaaattggatggagtcttgtctgagtgggctccacttgcactgcagctgagggacccctgaaagcagcctgctctggtttttctaccccatggtaacatgacttgctgggataaagtgttaaaggatatcctgttctacgagggagaaaaacagagccagaactgttgcaaccacttcctccctatctcaggatgttgcattcccaggacattctacagttaatcttttttttttttttttttgagacagagtcttgctctgtcatccaggctggagtgcagtgacacgatcttggctcactgcaaactctgcctccttggttcaagtgattctcctgcctcagcctcctgagtagctgggattacaggtgtgtgccaccacacccagctaatttttgtatttttagtagagacagggtttcaccctgttggccaggctggtctcaaactcctgacctcaagtgatctgcctgcctcggcctccaaaagtgctgggattacaggcttgagccactgcacctggtctctacagttaatttgaaaattgtaagtgaaaaagtggggagaactggttcaatccaaggccacctggacacctggagaactgtcctgcacctaaaagctgcaaagatccagtgcaacactgcagacaggctcttgctgattgcggaggagagaagaaaagggcactagacaacttggctgggagaagatttctcgaaagacgtgatggggataaatgtgccaccaggagccctgctgcaagtggtcacccactgaggctttgtcggatcagatggatttgtataatttaggccccttctatctccagctctagctggttgtcagctagctggttctgagccctgcaggaggcagccaggcacccagtaggctgcccagacagtttgaatgcaagaggtccggatggagatgcagggagctagctgagttatgggcgcctggggaggtagagatatgtaacatgaggggcgagcaaaggccactgcacttcatgacaaagactaaaaaaaataaaataaaagaggccatgaaaaggctttccccaccatgaagtataataaagactaggaagcatttaagcatgatcaaagacctgaaaaactctaagattgtggaactgagcaccaaactaaaatacatgcgcctctaagtctgatgcttattgaggaaaaactcaagaagtttgccgaaggacataaagtgtctataaaaccttgtttgttgcctgtaaggtcgggtttctttaatcgaaagattgtcctgatgtcatagtgagtaataaagctgtgtgctgatgcagacaatgcagaaatctttaggaaagggagagcctctctctttggaagtggtctctgcatttcccacctggataagatttgtgcaaggcagagccttcaggaatgtggcttcaagttgttatggcaggtagttagacaggagcagggcaggagagggctcaccacaaaccaagaatgtcaggcgaccatcaggtgatggtcaggtggttgttaactgtctctctaaaataataatttgtcacagcaagctccagggaaaagcagtctcccaatagacagaaatacctgaaaccggtgatcagcagcttcctaataagatctcaggaatcgggccagtgggttcaagcatgtgcactaagaggcaacatgtcagagtttaattggtatacgaccttctaggaacaggtgactggtaaaggaagaacgcctcaagtgagcatgtgtacaactccagtaaacacactgcacatgcagcccctcccaagtgctggcaggccactgtgcacgtggacagcccaccccaagaagagaatcaggagagaagggagacttaagactccagaagtatgccaacatataaaaccccaagtcaaagctcaaacagagcactcgactctctcaggttgcccgcttgaccctcttccaagtatactttacttctttccatgctggacctaaagctttttaataaactttcactcttgctcttcatcttgcctcggtttctcttccttatgcctcttggtcgaattctttcttctgagaaggcaagaattgaggttgctgcagacctgttctgatctaccactgctaacaatgtcagactttgggatttcaaaaacgggtaaaaaatgtttttaaaaagggaggtaatactaggttgaaaatttttattttgccaactgaggacatgaaaaatacatcattccaccatttcataaaaataggaagggcataatctaagataaaggacaacccttgaatggaacacatttagctttaagtggaacccaggtgtaactgacttagtctatttcccacatccacgctggagcaggacttgtcatttgatcacatcccccaaaagtcaaataggattctgcaaatcattagcaagtaatgcagattttactgatgatttggtgaagcaatgggatagagtggccttgtaaaccacaaaacagaactaaagtgaactcccctcgccgtgactgtgaacttctccttggtgacctcatctccagttacctcatctccagctcatcattccccttgctacctcccagaaaggttgaggtgggtgccggaacatcagtttattgcttttcataaaaatgggcagacccaagagtgaaatagttgaaatctgtaatccaaacatctcagccttccagcttcctagggtgccctttccaccaacatctaggtaaaggatgccagcctgctgtgggaaaaccagtgctgtccccagcagtgccatcggcaggggaacagggtggtgggggaagcctgtgctcctcactggccacctttttccttaggcccctgagttttcctcttgttgggggcccctttcttcaggctacctcctgggagaggttcaaaatttctgtgagtttattatgcagtgcgatttagcttcttctttgtctcatcctttccagtccaaagcagccctggggcctctctttgcataattaaaagatccattaaggtgttttcccaaacaaaagagcagttttctccctcagaggaattctatcattctcttaggacaaccatctccaactgcggtgagatttaattaggacaaccatctccaactgcggtgagatttaaaaataatcacacacacacacacacacactcgaactcagaatgagagcgagagagagagagagagagagagagagagagagagagagagagagagaaacatcaggcatctcttccctgtggttgaggtacaggtggaacagattgtaaccagaagctgctgggttgatttactagaatgcatgactccaggaaggcatatgtggccagcagtttctctgtgtctgcaggtagagactgaatgtggagtcaggtagatggaatgtctggtgcttccaccccaggatgagagatgtctccccttcaggtatggaagagctcttggtctgctgctcccaactcctgcctttaccttcatgcatgaatctcctcaaggccacagccaagtgcctttcttcctgtgcagtttacatgggccctgctgtccctgtcctccatgaccctcctggttcctgtttccccttttgggctttgccttttggaagccttttctagttccccttctgggctgacccaaaggcaggctagtgcctcagcacaggctacagtggagggccctaccctgggtgttgtttcgtcgtatttagggcactttccatgtcccttgtagtgctagtctcagagcttaaccaagttaagctcaagctggtctccacggtctggtcctcagggcagctggagggtcatagccctgagctggccccatggtcctcagggttggggtatcatatccctgggctggtccccatggtgctcagggtttggggatcatggtcctcagctggtccaaggctgggggatcatacccctgggctaactccacattctcaggggtggagatccactgactgtgaggccttcctctctctttgtgctggctgcaactcaatcctactctttcagaggcctcttctctcccaggaagccttgtcaggctgcttgagcttgagaagaacaccactggggatgttgttagcatcatattcaagaagagtgtggatatttgggtgatgtccagtggctctgtactggaacttccctgtaaatgcagaaaccaaaggtaacggggttaagcctttcaggagagaatcactccaggccagtctgaaggggaaatgaggtgggagtgttagcagagtcccctggggaggtcagttcccaaaactgcagggtcatcagtcttcatggcctgtctctgagcagcagtgcaggggctgggaagactgagcaagtgtcctgaaggctggagctggaagcttggggaggaagaatgttgttttctagcatggatcagtgttttagtctttccaggctgtaacagaataccataaacaggatggtttataaacaacagaaatttatttctcacagttctagaggctgggaagtccaagaccaaggtgttggcagatttgatgtctggtgagggactgcttcctcctagatggacttcttgttgtgtcctcacttggtggaagaaggaagggtctctctggggcatcttttatattttggtgtttggcctttttttttgagatgaggtcttgctctgtcatccaggctggagtgcagtggttcgatcacagctcactgcagatttgacctcctgggctcaagtgatcctcccacctcagcctcctgagtagctgggactacaggcacacaccaccatgcttagctaatttttttattgtttgtagagttagggttttgccatgttgctcaagctggtcttgaactcctgggctcaagcaatcagcctgccttggcctcccaaagtactgggattacagatatgagccactgcacctagcctggggcatcttttatatggtcactaatctcattcacgagggctctgctcccatgacttaatcacttcccaaaggccccgcctcctaataccatcaccttggaggttaggatatcaacatatgaattttgggggggaaacaaacattgagaccatagctgttggtattccctcccttcttccacaccagtagtcttcactttataaggaaaagcagcaagtggggtcatgggagtgggaaacaccaagaccttgagaggtcgtggtcccattttagcctttagcagagcacaagcgtctgcccagggcagacaatattcttgccttttgggccattgcagttggaattggtggtaaacagccccaagcccagctcttgccccgtcattattagggtgtcgttattacttttgcaggctgaacatatatttgggtgtaacagggttctcttgagccaaaccagtgtccatctcttgaattcagtgaggctagatatctctggcaacagtgggacaggatgctcttttgtgtggattatggtcctttgggaagagtcctcacctaggggaataggcggccaggccaatagatttgctcagcagaagtcattaggggacaggaaagttctgggtcctctctctctatcactgacttccatggactcatgtctggatgctaaggtatgggagagcagatgggtggcatggttggaattgcaaaagtcattttcctaaaattccgtgaggcagtgaggcacaagcaactctgttccagatccctttgatagagtggcatgggaggagggaggttctgcctctgctttcaactgctgggggcacagctttgcatctggaggaatgggccctggccccacagtgatgccaggtggacccagcagtacccagcagaagcgtcagtgtcaggcagacacagttcccagcagaagagaaatacatcagctgtcatatagcaactgaccagccatgtccatgaacatatgtgggacacctgctggtactcccagaaacactttgggttgggggatttgcttgtcagcagccttggaatgacatgagaagaaaaagaaaccaggttttctgttgaagaaaacagaaccccatttttgtccacagacggatccttccaagcagctgctctgtagaagggctgggcctgtaggttcctgcctcgcatgtaccctagagatgagaggctgcctggcagaactgccggtggctgtggcttgggctgtcggggtcttggggcctggatgcaatgtgatctgaccctgggctgcgcagaccacccagctcatagccctggctgccgccagtgcctgcaatttctcaaggtgaaagcactctccagcgggtcattcgtccgcgtctgagtggttttctgttcgtggaatcatttatttctggtgtcagggaggcccagggcgacttttcccactggctgtaaatgctccgagcatcatcgattcgtctactcccatctccggaaatctgctggagcagcaagtctgtctgggattcctggctggaagggcatggggcagggcaggggctggggtggctttggttccctccctctcagcagaggcaagtggagggatgctgaagcctccccatctctccagagagcagcctcatggtttgggccctgtgttggagtttcctgatctgcagctggggaagtgtggctagcttggcttgtaatgacatctgacactcttgaagcccacccttgaagcccacccagggccactgaatgtgccccagcttggctgaggactccctcagagggcattctcctcctctcaaagatgcccccagatctccattaatcctcctgtcagtaggctggagcccatccaggtagggacggcagcaaaaccccagactgtaggcaggggcaccacccagccccaggtggagcaaagtggactggagtcagtgtaatgcactcacctcacagcgtgatcatgagactttggggacctcatgcgaacttgcctgtgtgtgaatgcctgtgtgtgtgtgtctgtgtgccatggctgcagcatgtgtgggcctccatgtcatctttgtgtttgcacatgatcttgtgcgatgaggtgggtgctcgtgggcttctatgtgtgtttatgcatgcatgttcacttgggtgtgactttctgtaggtgttcatgtgtctaagtatgcatgtgtgtctgtgtgtatgctggtatgtttgtatctggttgtgtgtctggtgttcgcattgctgtgtgcgtgcatactcatggtgtttgtgtgcctgtgtctctgtgtgtgtgcatgttcctggcatgcgtttgtgtgtgcatgctcatggtgaatgtgtctctgtgcatgtatgctcatggtgtttgtgtgcttgtgtatctgtgtgtgtgcatgctcatggcatatgtctgtgtgcatgctcataatgggtgtgcctgtgtgcatgcatgctcacgtgtgtgtctgtatgtctgtgtgtgcatgttcactgtgtgtatgcatgctcatggcatgtgtatctgtgtatgcatgttcatggcacatgtgcgcctgtgtgcatgttcatggtatgtgtctctgtgtgcatcctcatggtatgtgtgtctatgtgtgacgcatgctcatggtgttcgtgtgcctgtgtctctctgtgtgtgcatgcttgtggcgtgtgtgtgcccatgtccgagtgggatgtgtgtagggcttgtgcctatgtgtgcatgaggatgcctgagagtgtgcacctctctccagttctctctctcttcttaatcttttttacccaaggatttatggaaaattccagggtggaggtggtggctggggagggagacccttagctatagtctcattggcctcagagctgctctggagccagaggggacaacatttcccaggctctaagagcttctcctgacagaaaagcatcaatctgcttgtcaaagggaaaatggccatttgtccttgtctggaaggacccgagggcagggctggacctgagtaatctctgtctcctgggcccagcaccaagtagggtaagtgacggatgagctcaggggctggcaggctgttcaccctgggggctgacacaggcaggcagcctggtgggggtgggctgcagcttggaagaggtgggagggtcaggagaggtgggggctgagggaactggcctggtggaggttgtgttggggctgcctccgttggcagctggggcaagaggctggggatgatgggtgagccttgagggtggggtggggccccattccttactgataggccgggaggaacatggcacgctcagcatctagagacactcccagccctgaccctacttgtcaggccctgctgtcaggaggccctgggtggggaaagggtctgtttcggggtttccctggggaagggacaactcttctccatttcctcacctttcccctgcactgtctcctaagtgttttgggcaatccttgcaggtcttctcatctgggtgggtgtctgctgtgtgactgcctgagaaaactgatgaactttgagatcaggcccttatcctgggatgtgactctgccactgacctctgaccagaggcttctctctctgtgcctctatttccttctgtgcagtggatagggaccttcctgatctgcccatctatgatcctagggctggtaaggcctttctgggagcaggagtggggacacccctatgcacactcttcccctcctttccctttctgtgatttgccccacgagagtgaggctgctgtgccggtgggccttgcagaagagtcccttcctattgggatagtccaggcttcatgacaccccagaagcgagtgggcaggaacctgtggttacctagatgatccatctgagcttggtcctacatccgggggtgagcgggtagaggagggagccacatgctagggctcacattgaggggatgaggatgccacaagggtgggactagatgacgccttcctcctggtacaagtgactcttcagccggtgaggacagcacattgcacatgtttatttggcccgttcgtctaatgctgactgaactcttactctgggctagagactctcctttggcccagagaacccagactattttcaatctttgaggatcctggtatatcgagaaatgaaggtcctgaattgctgcccttctgtagttctctccttgttgaatccgggccagtcttgtggcttgcttgggcaacagaatgcagcaaaagggacatcgtgcaagttctgaggcacgatggagccttacagcctctgctttcagtctcatgttgccctaggactccctgtaaaggagcccatgctaacatccttgaatataggaagccctgtggaaagagagtgaggcctagcccactctcagccatgtcagtcatcccagctgggcctaagcaggtgagtgaggctgtcttggttcctccacctccagttgaggtaccagctggctgcaagtgcaagagtgagtcagctgaaaccatctgttgcagaaacaagttgctcagttgagcacagcccagattgctaattttaggctactaagttttggaatagttgttttttttttttttcatgtagcagaggctaactgaaatagaaatttgaaataggagtagaggtgctactgtagcaaaaatttaaaacatatggcagctgggcacagtggctcaagcctgcaatctcagcactttgggaggctgaggcaggaggatcgcttaaggctaggagttcgagaccagcctgggaaacatagcaagacctcaactctaaaaaacaaacaaacaaacaaaaaacaattagctaagtttggtggctcacccctgtagtcccagatacttggaaggctgaggcaagaggattggttgagcccaagagtttgagggtgcagtgggctgtgatcctgccactgcagtccagcctgggtgatagagcaagactctgtctctaaaaataagtaaataaataaaataaaaataaaatacacagatagactttgggacttcatggcagctggaggatggaaggatgacaaagaaactgttattggacaatgggagaacagtgaggaagctgttattggaggctggagaaaaggcaacctgtgttatataacacaattagtgttgtttggaggatagaaaatgcagctaataaacctgtggatctagctaaggagatttccacagagaatattgaaagtgcctactggcttcttttagcagcataagataaggtatcataagggagggaagaattcaagaaggagccattcagttttcaagcaaaatctagacgcaatatagacagtctaggacagtctctccagcaaaagatactcaaaataagaaatggtcccagggtaaagaacgaatcaatattgtggctgtaagactctgtttagacctcagaaagatttaagccagtacctcgtagatcctcttagctagacaaaggagcttctgaaacaatctggacaccaacccaaagtagaaagagatgtagctcggaaagtattataaatgtggcttttgaagcatggagtcgctcccacccagattcatgggaaatccacacaaaaaagagaattgtcttgggaaaaaaaatatactaacttggattaaaaggtacagaggctgagtgtggtggttcatgcttctagtcccagcactttggtaggctggagtgggagaatggcctgagctcaggagtttgagaccagcagcctgggcaacatagcgagaacttgtctctactaaaatttttttttaaaaattagccagctgtggttgcgtgcacctgtagtcccagttacttaggaggacgaggtgggaggattgcttgagcccaggagttcgaggctgcacttagctatgatcacaccactacactccaacaccccagcctgggtgacagagacagactctgtctcaaaaaataaaaataaaaagacagaaacaacaaaatgaaaaacgatctctaggcttccaactttttacaggcagaaaacagagatccagctgtaaataggatctattcatttttgaaaagggagatgtctcagatagtggagcccagagtatgaagccaagaaccaaagagaacaataggttaggaaatcactcccaggaagcacaaaataggtcctagtcaaagaaaactccttgcctttagagtagagggaactgataatatctgcccagctagatttcaaaatcactatggaatagtgactacatgtacctcccacttgcctctcccctttgttaaattaattaattaattaattaatttagagacagggtcttgctctgtcacccaggctggagtgcagtggctggatcatagctcactgcagccttgaactcttgggctcaagtgatcctcctaactgggactatagtcgcatgccaccatgactggataatttattttttgttgttttattttattttttggagagacagtatcttgctatgttgcccaggctgatcttgaactcctggcctcaagtgatcctcccacatcagtctttcaaaatactgggattgcaggcatgagtcactgtgcctagcctacccccgccttttagatgggggtttctcttgagggatattctatccccatcttggtatggtatgttaagtgtgtcgaggtcaaataactttttaattcctgagtctttggatcaacataagctctacccacggaactacacctaaggacccccatcagtctctgcttctgtggttccttgatgttcccctgcttctgtgctatatgtagggaacaagaattgcttcacaggagccctaatatcttgggtgacactttctataggggaagcacaggcagccctgatgggttcccccagtcatcttttccttttttgaaggataatacatgttcacagctgaatcactctattggctggtttcctgcctatagaatcccagaataatggcagctttctttcattttttcctgtctctgttccatttagcccaagctggtagtgttgttggtgacatgacattctcaaaatcctggtgggtctcctgtgtatattaagaggatccacttcattagacacagagttctttacagatccttcctcggtagccccatctctattcctggctcctgctgagatggttggttggatccgtaatttgtacatctaacggcaccagaagattgctcagccacacccttggtgttcctctagagcatgccttatcatcttttataatatggatgagttgaaaatattccaaataatcaagttctggttcctttttgcttagtagctccttctcaatttatctctttccccttgcattttactaaaaacagcaaggagaaaccagactgcaccttccatattttgcttggaaatctcttcagctagatatccaagttacttaccagttctattttccacccaacactaaaacacaactcagccaagttctttgccactctttcctccagtttccaatgataggctccttatttcaatctcagatatcaccaaagatctttaatgttcatatttcaactgatattttttcatgacaatatacattttctctaagatgataggtgctttctctgctgtgctcttccttctgagtcctcaccagagtatactttaatgcctatatttgtactgataatctctttcgacagtctaggcttaaaattcctccagcctctacccatcacccaattccaaagcccttacatattttaggcagcaccacttcttggtaccaaaatctgtatccgttgtctagagctgttgtaacaagttaccaccaactaggtggcttagaccaatagaagtttatcatctcacagttcaggaggccagaagtcccagattaagctgtcagcagagttggatccttctggaggttgtgagggaggacacgttccatgcgtctccctggcttctggtggtccctggcaacctttggcatttcatgtcttgtagttgcctcactccaatatctgtctccatctttacatgactatcttccccatgtttgtcctctgtgtcactttatggccttcttagaaggataccagaaggtccaccctaaaccaatataatgtcattttagcaaattacatttgcaaagaccttatttccgaataaggtcacattctgaggtcctggggttgacatgcattttggggggcacactattcaaccctgtacaaatattcattaatttcttaactcctacaaccctctgaagaatacttgcatagatgcgtgagagaggaatgaatttatttcagaagagactgtaggaaatacctggtcccatgtttggtccaaggctgtgataccctccatagtattcattgtgatctttcttctcttcctggactttttcagtgcagtgttcccgggttatcccaactaaaaattcaacccatcttgtaccctgattgggattgacactaagtcccttgtccttgctttattttctttctagcatttatcactattaacaaaacttatattttacttatttcttttgttcattgtttgccttccccactgggatagcctctgtgagggcaaagatttttgttcatgtatccacttctatattctcagcactcagaacagtgtctggtgcatagtaggtgctcaataaaaagttgtcatataactgaatgcatgcgtgaatgaaaggactcctggaaactgggcatctagctgttgtggacagggagcccgttctttcactgggcaaattttgccatttttagtcatgtagtgaatccttagaagaggcagggccaggcctccagagtccttgctttgagcctcatgggtctgttggacagtttcagaatcttaggaaataattggggtggttggttggctggaggagaaaatgaaataagagttgggattctctggggctgccactgacccactgggtcatcttgacaactttgttctgtctctcctggcccctggctccctgacctcagcctccttcacttggctatctggaaagcagttactttctctcctggccccccgttttctctctttggcatgtgggaattaaagacaaaaggtctcaaaatcactttgaactccatggagggtgccaaataatctgaggacattattagtataagacaattcctttgaaaatggaaattgcgtatcacacaatctctcaaacacagggtggaattaatgagcaatttgctcaagattcacaacttcaaaatgatcttccaggtggccaaaggaaattcacatttacacttcaatcagaaatttttttgtagaatgtaaggggggagggtttaattttctgagatcacaaatgcctatccccatcccaaggagaagagagcccgtgataaagaccgccctggtatctgtgaactctccagctaattagaaaagtgaatctaatttcatggatttcagctcctattaatttatcctaagcttgttggtaatgaagccatgtgtttgtttcttaagaaggaaacatcagagaggaagagaatgggtgtgaggctgtgctgtttattcccttaccttcaatctattaattgaggaaataacatatgatttaatatatattacaatgtcatcaacacagcacttgctttagctactgatggagccctgtgtggttatctcacataggcttacagtgcctgccacagctaagaaagaaggaataactgacagggaagtgaccaacagggtctgctaccttcctaatttctactgcttcattctatcctgtaatattcagcaaacatctattgaacaccttccatgttccaggcaagctaggcttgaacaagactgatagggattttagaacctatgtacgaccatcttaaacacataattattccaaatgattatttacaattgtgataaggactttgaaaaagaagtagtgtgttttgtacttcccctttccacatagatatcttgttagccagctagagaggaaacttaagacatcagagactggcctgagctgtctttcataaatcctctgtaatcattacaagacaaagctcaccttggtacctagatattatgtagagtattaactgctcagagtttagcagtagagattagtaaaagtaagtaaatgttcaaataagtgtaaaattctgaaacagactagtatcaacagtatctggacaaacttggcactaaacaaagcaaactggaggctctggcctctgagatgagaaagttcgtccccagatacaacacagagactgacaagagtagacaacagagtctagctcaagacagaagtgttaaattctagtgccatggccaacattagccccttgtttcaggagatttacatgtaagattttctcaacatcagccatggttagaactgtagtcccgagggaaaccagccattcatttcagggaaatgtgggtgttgacaagggaacccttgcaggagtgttctacaggtggtctccatcctgcccagtaagacttggctatgggagtgagctgtgtgaggggggccaggcaaacagcgatgagatccctttatgtggaaaattatattttcccaaagtggccacaatctgtttcctgttttttgagaacttgctactgctccatcaagatgtggattctgtgtctcctctccttgaagccggatggccctttgtgactgccttgatgaattaaatgtggtgcaagtgatgctgcatgactttgaggctaggtcatgaaaggagatgtgacatctgtcccacttgcatatttatattctctctctctttctctctctctcagtgcttgcccttggaacctaatctccatagtgtgaggaagttcaggccatggaaagactacaggagacatgaggggaagtctgcagggggacttttgagaaacgtttcctcacttctaataaatagctcaggaaaatatggtttctcttctttgtccagctgtgatgcctgggaacttctgtggcaaccttgcttccagccaatacacagagtggggcaactctcagaaaaccattgagaagagagtcagagtgctgaagtaccgtgtctggaatcctgtcttcccaactccgtgtttcctgatctatcaggtaataaaccctcttacatgctaagatactttgagttgaggcgttctgttacttgtagctgaagtaacattctccctgatttggaatctgctccctgagggctttggtcagttcctgccctctatgtgtgttctggggacctgggctctcccacaggagtcattaggctgcagagagccccccagagctgtgctttgggagtcagaacagagacttctggagttggatccattttctaggagtgttcatgatttcagcagaacctgttttattacttcttctagggttacatgtgtgagctgagcctttgtactttagagatcatttcctgagaatgagaagtggagaagggggcagggagtcatcctttatttgttatagtcccagagacaggtgacatgagagactttccttggtggcagaggatgaaggaggagggcatgaactgtggagtcagatccaggattgaaccttgacaccttccttgcaggctgtgtgaccttaggatggtcacttcacctttctagttctcagtgatcacatcttaaagtggaagtactagtcctatttcagaggatgcaattggaggtttacagcctgttatctgatctgcaactatgtttagtcagctgactgagtggttttttttgaaaaaattgagtttattcacgggtgtttacaaatataaaaacttaccaacttgtaaacttcaaatatctggagtgtgttgtatgtcagttatacctcaatgaagctgttaaaagttgaatttgttgtttacaatcaggaacgctggaatgttggtttctttgggggaaaagaggggaaatatttggcaatgctgagcccacctttttgtgaggttgcagagggctacctccttcagacaaggcatccctgcttcagtttgccatggtcccaccagcacctcttgctcagagtgagttttgctgctggccctctggatttgagtttgtgacctctgacctacctcatgtatttatatgtaagcctggatactcagagagtggtctgtagaccagctgcatcctgagagcttgttagcagtacagaatctcaggcctcaccccaggcctcctgaatcaaaattgcctttaaacaagatccttgcacattccttgtgatccttgtgattctttgcaccttcaaatttaaaaagcactgcctctgatgatcagaaatcatgtctaaaagtcatctggcccagagtaggcacccactaagggtaaactcttgctgtgtcatttaatccacagggcagttcattgttcagaggagctcacacttaaactgtactcagtgattctcctggatctcacagccaatagggggcagagctgggattcaaacacagggctgtgacagagatttatgctcttccctctctaccacctgcccccctaagaagagaaagaaagcatatgcagagggagaagccatagaaatcacctaggagacccaagcttatctctggggataagatcagccctgtagagcaggtggcaggctctccccagggctacctgaagtttcactcctttctctcagggcatggcccagagcttggtgcagagtacagtctcaatgaggaagggggaaagggaggagataagggaggagggggaagaggagcaggggaggaaggagggatgatatcaaacaggcatgtcttcagttacctgcccagccccatgccctgggtgaaagatagtgcattagtccatgttcacactactataaagatactacctgagactggataatttataaagaaaagaggtttaattgactcacagttctgcatggctggggaggcctcaggaaacttacaatcatggtggaaagcaaaggggaagcaggcactttctttacaaggtggcaggagagagagcacgtggaggacatgccacgcttgtaaaccatgggatctcataagagctccctcaccatcgcaagaacagcatgggggaaaccgtgtccatgatcctgtcacttcccaccagatccctccctcaacatatggggattacaattcaagatgagatttggatggggccacagagccaggccataccatatcagatggtttatccattaggacttgcattcagtcaagagatggaatttaaacctgtaagtatttattatttttttaaccccacacaacaagagtgataagtagtggtagtgttttagtggttcaaagatttggatccgcagtctctgtttctcttggccatttcctcatggtcacaagatggctgctgcagccccacttatcaggacgtgggcaggaagagaggaaagcaagtctttcttagaaaccttttaatgtatgtatgtcttattggccagaggtaggctagaaaatataatgtttaatttagcctttttttttttttttgagacagagtcttgctctgtcacccaggctggggtacaatggtgcaatctctgctcactgcaacctccaccacctcctgggttcaagcaattctcctacctcagcctcccaagtagcttggattacaggtgcgcacaaccacgcctggttaatttttttttttttttttttagtagagacaggttttcaccatgttggccgggctggtcttgaactcttgacctcaagtgatctgcccgcctcagcctaccaaagtgctgggattacaggcatgagccactgcgcttgacctgtttaatttagttttgtctttagctgggactctttgttctgttgatccctttctccacccccaccttcctgacaaatgaggtttatactaacaagaaaggaggacacggttattgagtagacatctggcaatgtctgccacgaatgggaacataggacctaattcctgattccttgttgacctggagtagttctccctagtctggaggtagcttgcgcactctcttgggctcagctttgctctgggaatgagaagctgtgcctccttttgtccctcccaatgctgtggcccagcaaggcctttggagagaatccatgtgtctggggacagctggaccacagcctccccaccctggctgcacacctgttggaagctatatttagagcagtaagtctaaatcttggggcaaggagaagagagaagccaaaggggcaagaaaaaaatgaaagatgcagcccagaaaaatgggatgttattccctgttgtgcacagccacagcctactctgggctggttcttaagaagaaggaaggaatagctgtgggcacttgtgggggccaggctggaattaggaaaaccgctgttcacaggatttggagagttataaactctgcctgcgctggcatgaaggtctgtcctgaaaagtcctaaaaccccttctagaattgtagaactggggcccctgaaccttttgactgtggcactcacaggcagggtataagacttcgtgctctcccctcccctcaaatttccactcaggaaaaaactcaaggattataaagaatggaaagaaataaaacagattgaatttgccgtgctgctagcaatacataaatgattcacttagtagttactttagaatacgaacatactaggctgggcgcggtggctcacacttgtaatcccagcacttcggaaggccaaggtgggtggatcatttgaggtcaggagttcgagaccagcctggccaacatggtgaaaccctgtctctattaaaattacaataaattagctgggtgtggtggcaggtgcctgtaatcccagctactcaggaggctgaggcaggagaatcatttgaacccaggaggtggaggttgcattgagccaagatcgtgccactgccctccagcgtgggcaacagaaggagactcaatctcaaaaaaaaaaaaaagaatatgaacatactaaaggatttttgtactataaaacaatttcctaaaaacttaaaaataactctcaatagttttgttttacttatgaaagtagctgatatttgctaacagcccatcatagggatatgagtgattaagggttgaacatcaaacttagacggccttgatgaaatacaggaaaattgcaggttaaatattatcgctgccaatctggattattgtagactgtgaagtaaacctagcaacccactaaaaggtgaatggtcacattaaagctaaactaaaagaagcttttataataaaaatagcaaggccatcagtaacgaaacaaaaaccacagccagtgggcaacactgatgaagtcgtagccatgagcccttccggaaagttgtgaaattctaaccatttgcaagtgtgcttgcagggtaggagcttgacagtgttgccaagtgttgtgtggcagccaggttttttagcaaaggacacagtcagagtcctaggtaattttagtttatggatagtacattttagtaacttttcatgactcacttattacgttactagtaagtaacccttctaagccaaaagtatgagagtctatagaagcaggagtcacttgcctgtaagaagtgaagaagagacatgaggggtcactgtgacccactgtgggagctcctgtggcctggcagggagctgcagaccacatgtgggaactctgctttgagaagtaggtcggctactggaggcttttctcctgcagtgatctctgtctgtatggtgcagcattatcaaaaactttctccctactggattatttccattcgcacacacacaggctgtaattactcctatcttaaaacttaacttgctggacaccctatcccccccacctccccagttactaccgcaattctctccttgctgctggaacaaaaattctcaaaagagttgtctatattcagtatccccaattcttctctcattctatcttgaactattccagagggtttttgtccccagagtcccaccgaaacagcctttgtcaaggttgccactgacttccatgacagatgcccctctcatcctgtcagcgtcagcagctcatccctgattgcctgggacatttccaggctttaaaatggaaagtcttgtgttccaggaaccaccacagtcctgggcaaatccagactggaggtcgcctagattaatgacctccacattgctggatccagtgataatttttttttttttttttgagacagggtctcactctgtcacccaggctgcagtacagtggcatgatctcagctcactacaacctctgcctcctgggctcaagtgatcctcccgcctcagcctactgagtagctgggactataggcacacgccactgcacctgcacccgggtaatttttttattttttgtagagatggggtctccctatgttacccagtctggtctcaaactcctgggttcaagcgatctttccacttcagcctactaaagtgctggcattacaggagtgaaccaccgtgccaggcccattgataaattcttagttctctcttggacctcactgcacctttctaaaacacaactttttttgagatatcatttacatataataaagtgtacatattcaaagtgtatgaattagtaagttttgacatatgcatacactcatgaaaccatcatggtcatcaaggtagtgacgctatcctttacctccaaaagtttcttcatgcccatttgcaacccctctcttctgcctttcatacctgtgttccccccaattctcacacctgagtattaatagcaatacctaatagtagtagtaattaatagcattactcaatctacagatgtattacttatctatttataaaattggatctatttattatatataacttatgttttattatatgcaatccatatattataatctatttattatataaggattatatattatcaattactattaatagtaatagtaattaatagtgatacccaatctacagatgtattacttatctattgctgtacaaaaaataaccccaaaattcatcagctgaaaactgcaaatgtttatcatctctcatcttctgtgggccaggagtgtggggcgcaacttacctgggtgactctgcctcagggtctctcccaaggttgtaaccacgggatccgccagggctgtgatttcattttataggcaagacagaagtcaccacctctttgaaacctaatctcaaaagcgacatctcatcatttttgccatattctgttcattagaagtgggtcacaaggtcccgcccactctcaaggggaaggagttacacaagggtgtgagtgccagggggtgggtattgcagggagacgttttagaggttgcctaccacaacaggcaactattgatctgctttctgttactatagattaatgtgcattttttgttttaagtaagtggaatcatacaggatgtagtcttttttgtctatcttcttacactcggcataattattttgagattaatttatgctgttgcattgatcagtagttcattctttctattgctgaatagtatttgtacggatacaccacaatttgtttattcattcacctgttgatggacatttgagccacttattaatagttttgggctattacaaataaatctgctgtggacatccatctacaagtctttgtatggacatatgctttcatttctcttgggtaaatatttagaagtggaaaggctagaacatacggtaggtatatatttacctttttaataaactgacaaaccattttccaaagtgactgaaccattttacattcccatcagcagtgcatgagagattcagtttctctgtttccttatcaacacttgatacggtcagcctttttaattttagccattcttgtggctgtgtagctctattttgttgtggttttaatttgcatttccttaatgattactgacgttaaaaatctttctgtgcttatttgctattcacataccttctttggtaaagtgtctgtctttagaccatttttaactacgttatttgttttcctatttggttttgaaaattctctgtatatgctggatacacgtcctttggcaggcacatggtttatagacattttcttttggtctgcagcttgtcttttattctctaatggtgtctttcaaagaacattatgtttcaattttgatgaagttcaatttatcaatttttcttttacagattgtacttttggtgtcacacctaagaaatctttgcctaagtcaaggtcacaaagattttcttcatacttttttctaaaattttttgtagttttagtgtttacatttaaatctagggtcatttttagttaatttttgtaaacagtgcaagctgttggattgaagttcattttcctttgtgtggatggtccagttgttcctacatcacttgctgaaaatattatcttttctccattgaatttcctttgcaccattgccgaaaatcagtgtgtatctatttctaaattctattttttgtttcagtgatctattttttgtctttacagtagtaattatattgataattgtagctttaaaataattcttaagatcaggccgtgttagtcctccaactttgttcttttacaaagttttgcttttctaggtcttttgtgtttcaacacaaattttagaattagcttgtcaatttctaccaaaaaagcctgctggaattttcattgggattgcatggaacctacacataaatttggggagaacaaacatcttgagtctttcaacccatgaacatgatatatctctccatttatttaggttgtcattggtttttctcagcaatattttacatttttcagtgttcagatctttcatatctttctcctaagtattccatatttatttatgctattgtaaatggtgttttaaaaatttcaacttctgattgttcattgctggtatttagaagtagaattgatttttacatattgatcttgtgtccttcaactatgctaacttacttaagaattctagtagctatttttgtaaattccatcacattttctacataggggatcatgtcacctgccaataaagactggtgccttttttcttttccttggataaactccacttggtcatgatgtattatcctttcttacttattgttgaatttgatttgctaaaattttgtttagaacttctgcatttatattcatgaggaatattggtctatcttttttttttcttctgatgtctttgtctggttttggtatcagggtaatgctagtctcatggaataagttgggaaatatgccctgctcttcaatgttttgaaagagtttgtgcagaattgataatgtttctccttaatctctggcataatgtttgaaggaaattttcctcctataatgtttggtgaaaccacctgggctggagttttctttgtgtgacttttaaattttttagttaaatttaattttttcagagacagggtcttgctctgtcacctagggtggagtgcagtggtgcaatcatagctcactgtaacgttgaatcctaactcctgggctcaagtgatcctcctgcctcagcctcttgagtagctaggactacaggtccatgccaccacaactggctaatttttaaattttttgtagagaaggggtcttgctatgttgcccaggcaggtctcaaactcctggtcttaagcgatcttcctacctcgacctaccacagtgctgggattacaggcatgagctgctgtggccagcctttttgtgtgaatttttaattaacgaattaaatttctttaatagatatatggctattcagattatctattattcttgagcgagttttggtaatttgtgtcttttaaataatttgttcatttttatctaaggtgtcataatattaatttgttcataatactcccttattatccttgctttatctgtagaatctgtagtgatatcatctctctcattcccaatattggcaatttttgtcctttttctttttttccttagaagcccagctagaggtttatcagttttattatcttctcaagaaaatcgcttttgctttcattgatttttttctattgctttccattttctgtttcatccgttggccttctgatttttatttttttctttcttctgcctactttgcattttttttattattatactttaagttctagggtacatgcgcacaaggtgctggtttgttacataggtatacatgtgccatgctggtttgctgcacccatcaactggtcatttacattaggtatttctcttaatgctatccttcccccagcgcccccgctccccaacaggccccggtgtgtgatgttccccaccctgtgtccaagtgttctcattgttcaattcccacctataagtgagaacatgcggtgtttggttttctatccttgtgatagtctgctgagaatgatggtttccagcttaatccatgtccctgcaaaggacatgaactcatcctttttatggctgcatagtactccatggtgtatatgtgccacattttcttaatccagtctatcattgatggacatttgggttggttccaagtctttgctattgtgaatagtgccacaataaacatacatgtgcatgtgtctttaagtagcataatttataatccttttgggtatatacccagtaatgggatcactgggtcaaatgatatttctagttctagatccttgaggaattgtcacactgttttccacaatggttgaactaatttacactcccaccaacagtgtaaaagctttcctatttctccacatcctctccagcacctgttgtttcctgactttttaatgatcgccattctaactggcgtgagatggtatcacattgtagttttgatttgcatttctctgatgaccagtgatcatgagcattttttcatgcatctgttggcttactttgcgttttataagatcttctttttctagtgtcttaaggtggaagttgtaaccatttctttttttttctaaaaactgtggctctatgtcaacctttcttttctaatataggtgtttactgcttaaatttctctccaagtactgctttagctgtagccacaaattttggtatgttgatatgttttcattttcattcagttcaaaagactttgatgttcttggactatcacctccatctcctcaagctggggtgtctatcaggctctgcttgagacccatccctcttttgagtctggaaattcccttgcagcaggaagctggggtaagaagatggctgaccttatttatttcctgtctctgagggagacctgtctttcattgcttgatgtccagtgctttgaaaaccttgtttcatatggttgtttcatgttgctgaattcttttttgttttttgagacggagtctctctctgtcacccaggctggcatgcagtggtgccatctcgactcactgtaacctccacctcccgggatcaagcgattctcctgcctcagcctccttagtagctgggactacaggtgcctgccaccacgcccagctaattttttgtatttttagtaaagacagggtttcaccatgttggccaggctgctctccaactcctgagctcaagtgatccacctgtcttggcctcccaaaatgctgggattacaggcataagccaccacgcctggcctcatgtggctaaattctactaaacagtgaaagaacaataatttcaatgccatgtaaattctgccagcatatagaacacggtagcatacccttaaacaacttttaggagacttgtgcaggcttgattaaagaaaaaaaaaaaacagacaggacagtatgagaaaggaaaattatagggtaatttcgagtgggtaacaaagtggaaatcccaaacaaaacagcagtaaacagaatcccacacgggtaaaaaagataatacatcatgatcaaatcggatttatcctaggaatgcaagattgacttaatattagaatttttcttactgaaatagagattcatttttgttttacttgtttcattttagttttgattttagatgtttttttaacattaaattttatcattatggagaatgtttacatggttccaaagtcaaacctacaaaaccaggaacattctaagaagtccagccctgtccctgcccttgccacatttttctttctttcctgcccttttttctttttttttttgagatcgagtctcaccctgtcacccaggctggagtgcagtggcgtgatctcggctcactgccacccccaccttctgctttcaagcgattctcctgcctcaacctcccaagtagctgggatttcaggcatgcgccaccacaccgggctaaatttttttttttttttgtatttttagtagagttggggtttcaccatgttggccagactggtctctaacttctgacctcaagtgatccacccgccttggcctcccaaagtgctgggactacaggcgtaagccactgtgcctggtctctttcctgcctctttagtaaccattttttaataataaaaaaaaccttccattaaaaatatgattgtatcctacccctttttggataagtggtagcatactatacacacatttgccatcttactttatgtacttatatgtgttggaaactcctttgtcatgtacagaaatggttctcattcctttttacagctgcatataattccattatatagatatataggctgagtgtcccttatccaagatgcttgggaccagaagtgttttagattttggattttttttgtggtgtggggggagggtttggaatatttgcatatatataacgagatatcttggggatggaacccaaatctaagtgtgaaattcatttgtttcatatacaccttaaacacagagactaaaagtaagtttctataatatttgtaataatcttgcatgtgaaactaagttttgactgcttttgactgcatctgtcatatgaggtcatttgtggaattttccacttgtggtgtcatgttcatgctcaaaatgttttggattttggagcattttggatttcagatgtaccatagtttattcaacaatcccctgttgttgggtgggtcagggcaggtggcttttgcatttacaaataactctgtaatgaataagcttgcacatgtgttttttttctttttgtcatatttgggagatgtttctagaagtgagattgctgagtcaaagagtgaagacagagagaattttgccaaattctttccatggtgattgtacaacaattttgcattcctgccaccaaagtatgagagtgtctattctccagagcttcattaacagaattatgttgtcaaagctttgaatttttaccaggaataggtgagtatgagatctcagttttcatttgcatttctcttattaagagcaaggttgagcatcttttcatatggtcaagagccatttgcatttcttttctgttaatggtctgttcatctgacttgcctatttttctatctagttgaggtcttttctattttaggacgtttgttaaaatatcgggaatattaactccttgtattagaagttgaaactatttttccccagtgtattggttcagattttttccctaatgcaagaagtccagaggtggggactgtccacattggctccgtggtcccctgtgtcagggccagcttttctgagattctccaggcatctccccaacagtcacgttatgactatgtcaaaggcaagtaggaccaggaagggatggctccagagatacttgtctcttattaggaaggcaaaactttctcagaagccccaacagatttgcattcagatttaattggccagaactatgttataggcctctcacctccagcttcagggaaagctgggaaagaaaatatttcatcttcccagtctctggagtggaggtgggcaaggcaaaggagattagaatgcatgttgagttatccaaccaactaccacagacaagaggggtgagtttacattaaataaaagacctatcttttctcctgttctgtgacatgtctgcaaatccacagtaaatcagtagttgggcttacaactccaaaatggaattcagtttgtttgattgtttgtttttgagatggggtctcactctgttgaccaggctggagtgtgttcacagtttactgcagcctctacctcctggggtcgagatcctcctgcctcagcgtcctgagtagctgggaccacaggtacgtgccaccatgcctggctaatttttgctttttttttttttttttttttttttttttggagagactgggttttgccatgttgcccaggctgatcatgaacttctgggctcaagcaaccctcctgcctcggcctctcaaagtgctgggatgacaggcgtgagccactgtgcctggctggaattcagtcttggatgcctctgtagaggtttcgtgtccttccttctgaagcaaggaaggtgagatgacatctagagaccggtgtttccccgtaggagcctatttgtaaggagtactgctaaatgggatcatgtccagaggcaagtcaccagggcaggggagcaaggaccttaggaaccctgccctgccaggaaaagcctgaagattcagagatgtcatcttagcgaagatgtggaagagagcaagacatgcctcactgaaaacccagaggactggcatgtggaaaaaatcagatttgatctgtagtaacagttggtgcatgttacagtgaggcggattccaattcattttaaacagtagtttttactaattcgggatgggttgctttgtgaggccgtgagcttcctaccctctgtgtgatcagtcttgccactctcatggctttatccttcattactctctggttttatcctccacctctatgtcagtgattctctaacctgtgtctctcctccagaactctcccctgacccctgtcttcttcaacccaccacaaagccctttcttattctgagttggatcagtcagggtctcaccaggaaatggaaacctcttgaatatttaaaaacagagggactttaatgcagggaatttgttaaacaggtaatagtcagtcgcccagcctagaagttaaacagaggacagtgagacaattcaaagtaacagcagcaggaagcactgtcacccccaggctgcagggtcacccagcaagagctggaaccacagtgggcttgtcggggcagcatctataggaatggaaaacacacagcaactgtccgagattctcttaaagcagaggcagagtgagaaagagcccagcacccaatttcctgccaatgctccccagtggccaaacaaaataaaaaaccagatgatagagaaacctgagaaatgcagccctgcagagcacaagaaaggtgaaggagaatgggctgagcacagatacacaaggcaagaaggggtggaaggtctcctagattttctggggtctgtgggcagggctgggacactaagaagaaggttctttcagaagcagcctctgagccagggatttgtatgcaaatgatttttttttttttttttttgaagacagggtcttactctgttgcccaggctggagtgcagtggcacgaccttggctcactgcaccctccacttcttgagttcaagcgattcttgtgcctcagcttcccaagtagctggaattacaggtgtgcaccaccatgtctggcttttaaaaatttttttattttttaattttttttatttttagtagagacaggatttccccatcttggctagactggtctcagactcctgacctcaagcgatctgcccacctgggcctcccaaagtgctgggattacaggtgtgagccatcatgcccagcgtgcatgcaaatgacttataaagaaagtgtcccaaggagagctcagtgagagagtcaggggaagcagtgttggaaagggaagaagccaatggaaggagagatttcaggggaagactgaacatcgtttgatccggtggagaggtctgaggtataaactgcttctgagagtttgtgcctgctcaggcaagagggtgggctttttaaccctgtacctgtcagtccttgctggagggtgggaaggggatggacctctggctctgagtctggtggatgcctgtatgctccaggagcccaaggatgagccgctggagaaggtcacagctgcgaacgatgagtagcaaagcacatagaagctgggggtgggaccatagcattagaaaggggatgtgtgggggatctgggtagatgaccgagcatgtctgccagagagtgtgcaggtgggaggggatggtggacctttcccatagacatgcacatggtaaagcgggaggtagaaagcaatacacaacctcagagagagacagataaagtgccacgggtgggggtgctgtatgggaaggagaggttgcctctccgctctggtttgtgatggcaattttgctgtagtgactgtcgtagatgtagaagtacccttaagatgctgcacaagggccaggcatggtggctcacacccgtaatcctcgctttctgggaagccaaggcaggcagatcgcttgagcccaggagttagaggccagcctgggcaacctggtgaaaccccacctctacaaaaaaaaaatacaaaaaagtagtcatgtgtggtgatgtgtgcccatagtcccagttactcgggaggctgagatgggaggaaatcacctcctctgatcactgactgggttcttaaagccctggggactttggactacgcacgttgtgtcctttgttgttgtctcctggctctggggccatgttccttgtgctctaactttgcttctcacaccatggcaacggaatctggtgccttctcaggctgtctggggttgaccctgcagacccctggtgtctgtctctgcctagtccccaggtcattctgagtgcaactccggccaccttttcttttccaaatggtctggaactccccccttcatataacagggggctctctgttctctctctttaagaagctaatttctaaatataatcctgctgtattatgggtagatgcagcgatacagttaatgagtctctaatgtagacaattataacctagaatacagcttggcttggttctctaccactcacgtgcacagacagttgcagtaacacatacccactcacaattataatcttgttctctgagaaaataccatacccaggcctcacaggcagcagacccagagttgtgtacctgcacacacacacacaggcacacaaacactcaggggcccttacacactcagaaacatccactgtagtagaagcgaggacctgccactgtacctgcgagagaggcagaggaggtagctgtgtttatagcaggcggtcctgcctctgctcccaccagccacctctaattggaccagatggttacttgcccttggttccataagcaccagtacttttaggaattctttggtggcagaagcagaaaccaacttagagtttcttaggaatcagaggtatccacagaacacaagggcagaaatgatggaagggtcttacgtgggactttaactgaaaactggaagccgccttcagccgaggcagttagtttctctctctctctctttttttaaatcattctggggcagcaaggtcttccatctgtcatctgcttctcttttttctttctctcttctgtcttgctaaaatacctacattcaaatcacttgaagcatttattaaaaatttagagccctgaatctctggggatgaagccaaagaaactccacttttaacaaatgccctaggtgatccttcaacatgcaaaagtttgagaaccactgtgctaaggaggtacataattcaaacattgacacgtgccttcgagacatgccctcctagtcacagcaccaccaactaactaatttgcatgtctgtgtcccagtttcaaatttctgggagtcagaagccaactgaatcagcatgggttggatgtcctggtccagtgagctgtgggtgttagtgaggggagtggtttggtcccattggaaggtgtagacgctgacagagtagggacattgcccaacttgtctgttacagtgagatgttcccaattcctcataacaaattctcttttacagaagttggtttgggtgggctttttgtagtcaaatgactgctgaggcacaaattgtcagaaatactcaggcacacattgtcactcacacatgcatacatacgcacacacccatcattctgagcactgtggagaggtttgcttggtaatgatctctttgcagcttagtaagactataaagaaggtggggaacctttattaattatatatcttacattcaatgaaacataatatttaatttaaatacttgcgggaggcgtctttgatactttgatttgcttcccagaacaaatggcttctctccctccctggcctgctgagttgatctctcatgatgaaagaccaacctggtttgtccccttcacaggatttttgtcgtagaaaatgatgaaatgctttcccaacagagtgtaaagccaaggctgcagtcatgttgccaggcttgacaaggaaatgccaggaaaatctatccattttatgttttctagacaacaggctggggaggtgaggcttataacaggatcctctgggttgcagcctgagaggctgactgcaggaggcaggtgttccgtgcagatgaccccacaagcacggtaacggtggacactaccccccgctgtccctcaccctacatcagccatgcctcctgatcttggccacaccctcctttgtgcggggaactgttgatctctgtgggctctcaggagtgaaagaaaaaccatctcctgggctgggtgcagtggctcacgcctgtaatccccgcactttggaaggcccaggcgggcagatcacttgaggtcaggagtttgagaccagcctggccaacatggtaaaacccagtctctactaaaaatacaaaaattagccaagcgtggttgtgtgcacctgtaatcccagctactcgggggctaaggcacgagaattgcttgaacccgggaggcagtggttgcagtgagccgagatcatgccactgcactccagcctgggtgacagagcaagactctgtctcaaaacaaacaaacaaacaaacaaacatcatctcctgaggtgaaagtttggtggcctggtgacaattccagacaacctccaaacactataatgctacagaacctcttataatactagaaccctggcaaaacaggctaggaattcttgttttgaccaaagcttccagagttcagatagcccaagatctgattggaagaaggaatctcagagtacttccttagctgggagtttccaaagcaatgcatctggccgagtccaggccagctggctgaatgcatccctggaattgcctctcttcccttcctgaaagacgagagacttggcactaaatgtaggtcaagtttctatccgagattcttttctctttttccaagacaaagtctgggaagtagctgggctggggatggtttgggacatggaggaggaaatctaacattagttgagtgtctctgatgtgttagacactgtggctggtgtatgaatgtcactgcatcagatcctcacaagtcttgtgaacaagagaggtttgtcccccacttcacagataaggacactgagattctggaggtagtcacttgcaaagatcacgtaggaagaggcagagacaggattttaagctgcattgtttggctccagaaggtcgcccttttccactgcacctgccacaggagaaaggtaaggtgcaggcttctctggctgggtctgctttccccaactacttcttctttttttttttttgagatggagttttgctcttgttgcccaggctggagtgcagtggtactatctcggctcactgcaacctccgcctcccgggttcaagcagttctcctgcctcatcctcccaagtagctgggattacaggcacgcaccaccatgcccggctaatttttgtatttttagtagagacgggtttcaccatgttggccaggctggtcttgaactcctgacctcaagagatccacccgccttggcctcccaaagtgctgggattacaggtgtgagctaccgtgccccaactgctttccccaacttctaagggctcacagcagtggaggaggggcccggcaggaactaggagctctttggctttcacagggccaggtcgctttgctggctattctctctcccacctcttcattctttccctcttccaatcaaacaacctccaatcattctgaagcttaaacaaacaacaatgacaaaaacaaaacctccttgaccttcctctacttctaaccaccattttctctttacaggctgatgaactcctcttctcagttgagctactcaaaaaaagttatcctaatgtctcatccctaccttccccccccatcctctcttcatcccattccaaagtgggttcctgtctcactgctctactgcaactgccccagcagggccactaattaccctctcattgttgaattcattagacactttccattctcatattatttgatttctcagcagcattgacctgttaacctctcggtccctcatgataacttattttccttttctttcatgatgacatagtctctggattttcctccatcctcttgcctactctttctccatcttatttttgggctctttctcctccatccaaccttcaaatgttcaagtttttcagggcctggcctcaacctcttcccttctcattccacacttgctctccaatcccacccatttccttggcttccatgcctccacatttatgtctccagcctgcatgatccccctgagctccagatccacgtatccgactgttgacagaggagttggcaaatttttttctgttaaggaccagataataaatattttatgctcagtgttgtcttctgcaacaattcaactctgtcattctagtgcaaattcaaccatagacactaaaagaacaaatgagcacggctgtgctccaaagaaatttgtttatggacattgaaattagaattttacataattttcatgtgtcaggaaatagtgctcatcttttgattttttccaaccattaaaaatttgaattttatataatttgaattttatataattttcacacatcaggaaatattattctccttttgattattttcaatcatttaaaaatgtaaaaaccagatgacaagccagaagtgacccatgggctgtagtttgttgtcccttcatctgcgtgttggttcactgggatgtttcataggtgtcgcacaccagcatggccaaaatgtcaccctggacttgcacctccagatctcagtgtccacagctacgtcaaagaccctttaatactcataactgctgtgcaagaaactgagagtcacccttgatggagccttttttctcatccctccctggtctcaacttccaatccaagtcctattgattctccctcctaagtaagtatagcaggataatattgtgaactatctgctatgtttttttttctttttttcttttttttttttgagacagagtttcactcttgtcacctaggcaggagtgcaatggcactacctcggctcactgcaacctccgcctcctgggttcaagtgattctcctgcctcagcctctggagtagctgggattacaggcatgcaccaccatgcctggctaattttttgtatttttagtagagacgaggtttcaccgtgttggccaggctggtcttgaactcctgacctcaggtgatccacccacgtcggcctcgcaaactgctgggattacaggtatgagtcatcgcacccggccctgctatggtttttattctgggaattttgagtggtctcgccttctcctctccttcaagtcttttctcaaatgttacctctacacaaggtctcgtctgactgaccacccttttttaaatggcaacctgataccccttaccctgttttaaaaatcttcctttttgcacatatcacctattaatttactatgaaatttaagatttgctattgttattgctcattgcctgtctctctcctggctagaatgacagctcttcaagggcagagatttttgtctgttttattcactgctgtgtcccaagcacctagaacagtgcctggcacatagaaggggctcaactaacatgtgttgaatcaatgcatgctgctgaggcttagcttccttcatggggagggagggcaggatccgcagcgacaaagaagtcattgctattcttaaatgaaactctttgaagctggttctcggccctggctgcaaggcggaatcatcaattctgccctgcagaattgattaaattgatttattcatcaactaaatcaattgaactttaagatcaattgatcaattaaatcagaagttctgggaatggaaacttttcaggtccctacaaaaattaagccaaggttaagaaccactgctttaaagcgatagaaagacaatggtcagaaaagcaagactttcatttgtagaagccaggctttgtgggggtggaagaaagcatgcgtgggctctgaagatcctaagcttagatgactggccttagatgggtgtctgaaaagggaagaaaacagagcatgacacagatggagatgcaagtgccgctgggtggcaagagacgaggatcagtgaggacatggaggaggctggcacctcagtccctgtgtcatggttcagactaggggtgggctgggatgtaaagatggaggaggctgtctcatttcttccagaatctgcaagtatcaatgggggaacactgaagcagggaggacctgaagcatcctctcagtccatctcaccctgagaccctttcccttccagtagtgtgtgaagggagtgaggaaatgttcccgggccccagagaggggtcacgcaggtggctgatattgggatccactgtgctgtggtgcaagggaacccaagagacagtgggagggacagctccaggcccgtgcaggataggctcagtctcagaggattgactaggtccatgattgcaaaactgggtggtgggtcagaggaaagtagaccatcatacacttaatctgttgagaaaatgcagcaatggtcgctgttgctggaatggagggggagccaaggctgacactcagacaggcctagtcacctctacagggctcagcaccccctggctccataatgtcttccaaaccatggtaggtctgtgttttttgttcatgtaactctcgtaactgtcatcctatggtgatgtgagtattgctcaatgattattttctatctaaactgttaggcccatgagtgctaggaccacgtctgcacccccagaggctaatgcagtgcctggcacaggggcatggataattattttaataaacaaagagaggaatgagtgggagtcatgccgttagtcgttggctgagtggagctagaatcccaggtcctgggtcggcttgcatagttcctcaaggtgctactggaaggaggaaagcctcctccttgggtgccttgaagacaagacccacacatgtttgctgatttgagcaggtctgggcttgtctccacatgagtgggtcttgcatgggattcgtcagcttcggacacaggtgtattaggctgggccacatgtcacactgtgtcctgcctcagccctctcaaaacttggctcccctaacacctagaggggtcctgtcctggctaagggctttcccagctcccttcccaccccactctgcccttcccgctggctgtagggcttctccccacctccctccaccaggggctcctgccttccagtctcctcccagtctctttcctgtctctggactgaaggccccataaaaagtcactttggcctcaatcaatagaccatctctttaacaagggagatgctggtttgtaaaatggagcctccaaggctgggctgggtgcagagccagcccttgcagacagctctgcctttccggatggtgcattaggcagcatcagcagatttttgccttttatgaggacatatatgactccccaaagaaaccttaacagagaggggatcgggaaagtgggagagtagaaagaaaagtgaaggaacattattctgaaagtgcagagaggctgctcaggtttggttctctctgccaccttcctgttccttttctagagtccttaagtgcatcagtagcgttatgcaactaagaaattcactcacacagtgtgaacacacaagttcacccagatagagaacgcacacaaacatgcacacgtgctctgggctgtcacccatcaccatcacatacccatgatgctgttctttaggccagaagtgctgtctgtctgtcccctcccttccatactgcccggctacctcccggtcctctctcacgccttggcccacttttcaatcatcatcctcagggagtccccgggcccagtcccctggttaaaggcacaaggtgcctccctcttttgaggcattttctgtacttggaatttgacatttatttgcatatgacacacgcctcacctaccaggctgtaacctgcaagtgacaaggacagttttgttctatcttccacccttagcatgttgtcttgtacatagcaggtcctcatgaaataattgctaaatgaattaatggatgtgatagacaacttctaaaccagcgcccagtgctctttacccctgacattcatgcccttgtgtaatccccttcccttgagtgactcacttctaatgaatggaagacagcaaaggtgcagtggactgaatgtttcccccaaacatttacatattgaaatcctaactcctgctgcggtggtattgggaggtgggaccctggggaggtgattaggtcataaggttggggtcctcatgaatggcattagtgtccttataaaaggaaccccagagagctgtcttgccctctctgccatataggatatgagaagatgacagtctgcaacccagaagagaaccctcacagaacctgaccatgccggcaccctgatctcaggtttccagcctccagaactgtgagaagtaagtttctattgtttataagtcactcagtctctggtactttgcaacagcagcctaaatggactaagacaaatggggataggtgttgcctgtgtgatcaggttcccattctgtcctctctctctcctcaacttgcttgccctgatgcagctggcttccatgtgtaaagtgctctatggagaggcctgtgtggcaaggaactgggagtagcctccagatgacagccagtaaggaactgagaccctcagtccaccaacccatgaggaacccatgcaatgaccacatgagtcaaactttgagatgactgcagaccgagccagccccttgataagagctttgtgagaggatcagagccaaaggaccaggtaagttgtgccagattcctgacgcacagacactacaagatgataactgttgttcatttaagccactaaattggggtcatttgttatgcagcaatagatgagttttacaacaaatggatgactgagaaacaaccaccaacgccccatcatgcattgaagcctgtcctcatcatgtagttgaatacaatcaaatctgcccctccacacagctcaaccactttaccatacaggagcaatgttttgcatagacacacacacacacacacgcatgcatgcacacacacacacacattctgaaaggtactctccctttctctatttttgctaccttactaccccattcaggtagatagcacccaaaaatctcactgtgtcaggccagagtgccaggcccacttggaaaccaccccctggcctgtcactgagcccatcatcctcatgggccctcctgtccgtttctgtgtcaccactaaggccagagttaccaactgcccagtgatctcatcacagagactaagtgttaaggctaaggagctgcagcaagggtgggcaattgcaggggaagttgtccctcgagcaccccccagccacccaggtctgcctcacagaaggccgcctgtgcttctgtggctcagcccctctcctgctgtcagctgcaggcctggcctggccagcgtggaggaaataaaagagaactgttctcggcctggagcttccactagggcagcattgggaggtggcagtgcacacccttcccctgttgcctcacttgccctgtcccagcctccctaggctctggaggggagcctctgctggcccacggctcacagggcccttctctgggggttgtttctataaggaggaccaccacttaaactgtaacagaagaggctcacatttctggtgtggggacgggctaatttttagagactctaagccaggcagatcttccagcagtagcacagtatcctttattgaggggtggggagtggagtgaaggctattgacaagtcaaagtccagaaaacctgcatttcttctcctctctccctatcattaacccagagggcctgccttgtcctgggcctaatgaagctattcggagtctagagctggcttccctgggaaggatagtcgagggacacctgcaggcgttttgcttcttgctttctcagaccttgttctctctcaaatctgctctccgtaggcaaaatatggggaagattggtgctcttccatcaggccccatgaccctcctttgtggaaatgagcagcacgggccagtcttctagaaagattgtctttccgacgcttcctgtaggcaggtccaaggctgttgttctttgcctgtcacctccgtggagccactgcttccgtcccaagagcttgggtagtaggcttctggtctggaaagttcttactggcactagcagagtcacaggcattcactggggagggggccaggtgaggctggagtcttgtttgaaaagcagagttgggatgcctttagaataatcagtggtgaatcctcacatggcctcagtccctgcgtccctgagccctgcacccagcatgttgtacgtccacgtgtttttgtgtgtttgcgtgtacagatgctccttgacttatgatggggttatgtccccatcaaccccattgtaattcaaaaatattgtaagttgaaaatgcacagccgggcgcggtggctcacgcctgtaatcccagcactttgggaggccaaggcaggtggatcatgaggtcaggagttcgagaccagcctgaccaacatggtgaaactccatctctactaaaaatacaaaaattagccgggtatggtggcatgcgcctgtaatcccacctactcaggaaactgaggcaggagaattgcttgaacccgggaggcaggggttgcagtgagccaagatcatgccactgcactccagcctgggtgacagagtgagactccatctcaaaaaaaaaaaaaaagaaaaagaaaatgcacttaataccctgataaacctatctaaggttgaaaaatcttaaatccaaccataataagttggggcccatctataaaggcgataaaagtggggactcctacctggcaagtagccccatagttaaagaaattgaaaattttccctaatgcagatcatctgtcatctatctacctatctaatccctaataaaatctactatctatctatctatctatctatctatctatctatctatctatccatccatccatccatccatccatccatccatccatccatccatccatcaacatctatctatcttcaatggccaagtagctctgcatatcaaggaactcataatctagttacaaagaccaaaatcacaaatgagacgattaacagataccatgagactgttatacagttatgctgagataccttttataaatgccccagggattcagaaaaggaaatcagaatagctgataaaagcttcattaaggagaggggattgaccagggccttggagggtaagagagaatttgaatgggcaaaaagtgtgtgtgtgtttgtgtgtatggagaagttataagggggccgggatagggaggacatgaggaagggcccagaggcagtaaggatgcggaatgtagggtgaggagggaaggagacagctgaccatgtgcagagcgtggggggagaagttgtgaaatcagggacagattgtgaagacagacttagcgcaggtggcagcggggcaggcagtgggtctctggtccacgtcagacaggggctgcatgagtgatctgagctgttacatgcccttctcacctgttcttcagcctcccaggcaaaaatggggacttaccaggtaggagtccccgcttttatctgagtcctagaccttctacttcaagcctctcagggctgctttctctcttcccttccatctttactcagctttccaagagcctctactccttgtccttcagttctgttatactccagccatttgctgtctttgtgcctatattgacacagctgagcactaccccaaagcctcccatggccatgtgcattggagccattgtaacttcattgtctccaacagttccctccatgactagtaatctttctatgtctctaatggcctctgtttcctgctccacacaggccattacaattcttctctcagactccaaccccaccattcccctgcctgctgccctgcagcccctgtcaccatcagcaataaccttgcgaatgccccaacttcctgccatcaaacctaaacctctctgaacttgcacctatattttccttctctctcctgacaccacagataaatctgagcccttctctcatttttcagggaccactcttccctcccttgcttatatctgtaagctttacctctctgctggtctcttcccatcaacatttcaatatgttcaaggctttattatcttaaaaaaaaaaaccctcaagttttctcctttactttccatctttccccctttgtcatctcctttctttctttcgcaaccacatttcctgagtgttttctgccatcattgtctcactcccttccatgcctactcttcaacacttggtcattaaatttctgtcccatcctgtccattgagattgatttcctcaaaatcattgggacatgcttctgctaaatccaatgggcatttccatttcctgtttgtgtgacccgctagctgcacttggcactgtggaccattcccttcttccgagtctcacttcctttgtcttctgtcactctccctattttcttcccatctctctggtcactaattttttgtctcctttaatgcttttgctgaatgttgcttgaatgttcctgccctttgggatccttccttaggccctctgctcttgtcagccttcatactttgaccaggctctgtcagcgtctaaccacgatgacatctatatagtcaggactttgggttgcaaatgacagcaacccaattcacactagctcaagcaaaactaaagagaaatgtttggctagcataataggctagtttagaagtagagtgaaactcggcatgtctggatctaaggactcaaatgatgttgtcaggcctctttctctctgtattagtttgttctcacgctgctaataaagacataccctagagtgggtaatttataaaggaaagaggtttgattgactcatagttccacatagctgacaaggcctcacaatcacggcagaaggcgactgaggagcaaagtcacatcttacatggcagcaggcaagatagcttgtgcaggggaactcttatttataaaaccaccagatcttgtgagacttactcattaccacgagaacagtatgggggaaaccatcgccatgattcaattatctccacctgggcccgcccttgacatgtggggattattataattcaagatgatatttgggtggggacacagccaaaacatatcactctcccaccatttccactccagccctgtctctatcattgtcttggcctcattctcttctgttgcacaggatttctcatggagtctggggagggcacagggtgatcataaatgactcggccttttagcatcctagataactactctggaggaaagaaagaacttcttctcccattcctgggaaaggacagtggttgatctaactggagtcacatgctgactcaaaggacctgaatgaatttggggtagtaagaattgccagcccccctggaccacatggaattgtggaagaacagatccctaaagaaaaaaagagtgctactgccagaagaagggagaggaatacaggatgcacaaagcagatatttaccataaaagctcctatttatgttttcccatccagacctttaccctgcatttcagaattatagatatcttcatttggatgttgcaaactcagcaagtctttctttacacaaatttcctagaaaataaatccctacacaaaatgcctatggtaaggctgtattgggtggtacaaatccagggtagcaaagtataagagaagtaggcacatggggcagaggaggagggaagcaaacatgagatggtgtgttaccgagtgtttggggttgaattgtgtcctcagaaagatatgttgaagtcctaactcctagcactgcaaatgtgcccttatttggaaatagggtctttgcagatgtggttaattatattaagaggaaggctagctggattagacgggatatgattggtgtccttataagaagaggaaagggcacgcagaggggaggaggccatttgaagacagaggcagagatggagtaaagctgccacaagccaaggaacacctggggcccccagatgctgtaagaggcaagaaaggattctcccctagagccctcagaggtagcatggccctgccagcatcttgatttccaacttctggcctccagaactgtgaaagaataaatttctgttgtttcaagccacccagtttgtggtacttttttacggcagcactaggaagtgactgcaccaagctagccacaacttcgttaaaaatgcaggcaattttgggaggccaaggtgggaggattgcttgaggccaagagttcaagaccaactggggcaacatagtgagatctccatctctaaaataataataaaaaaaattagcagggcatggtggtgcttgcctgtagtcccagctactttggaggctggaggctgaggtgggaggatcatttgatcccaggagtttgaggctgcagtgagccatgatcacaccactgcattccagcctgggcaacatagtgagaccctgtctcaaaaagaaataaaataaaaatgcagcctgttgcttgggcacatggaaagttttataaacaggactaacagaagaaccatgccttggaacacttctttggggttgggggtagagagaaaaagatttagctggtggcttctttctgtacttataagccaggtctgtttcatggttaactcccacccatttctgggttgtgttaattggcccctccagggatccactggagaaaccagaccgcaagctttcagtctggtgcttcagctggaccaaaaagtgatcagagaagccgtagtctccaacgggttcagccaagtccagggatgactggagcttgaaagagctgttgatgaagacagagtgggatgaggcagaaaagctgtagtacattatggcatacaaagaactagagatgcagctttgcctaggaacctggtggatgagctgcaggacctgggctggaaaagaattaagcatttgtggcagctgcccatggaacatgtggagaatgtgctggtggcattgctacccaagtccacctcctgcctactacatgacaagccagtgtccttgttacggctgcactataagcagttcagatcgccaaagggcactgctctaagtccaacttgatgtgggatgagatgagcgtacactcatgattgcagctggagatcctcattgaccaatgattaagacctgtggggtagacggagatcagcaaatcttggggtatgtatataacaaggcttagtataacatccaaagtgcattcatcttccctctactctaaacacaaacctgctatttctgtgcttcctgattcaatgattggtagcaccagagactcagtaacttgagccagaaattcagagttgttcttgacttttctcttttctcccgtgttcaatcctttaccaaatgcagtcagttctgcctccaaaatatctcttgactctgaccactttctgtccccattaccacatactcttccaggccaccttcttttttaccttggatattgcaataggctccagatgcactccttaccttttgtctcattcacctccaaaatgtgcccctccctgcaggcagcatgatcttcccaaacacagactaatcaagttacacccgatagacagttcttccaaggctctttgttgctctttgtataaagatccaaacacaagtcccctgaagctctggctgccatgtaatcccttgcctcttgtcttgccacttcttgtcttaagtgctacaatacagccaggctgaacttcttgtggcctttgtacctatgatctcatttcatctatctgttcactcctccagcgagtgtctggtgagcgcctgctatgccccgcagtggcaggcactgcgatcccagcagggatgctcttgctcttgagcctttgcacatgctgtacctcctgcctggaatgttctccccttgtgtagaaaaagcaaacagactgctcacaatcttctcccttgccttcctattatagagattagaaaacgaagactcagctttccttgtagaggacacacagttctggccagtgagatcaaggcagaagtccatagagagggcatcctttcctgaataaaagtcctcactaaaggctttctgcctttctctctgctttccaccaggaacacgactgtaaagccaatgggtacaacagctgccctgcaactatgtggctgcaagaatgatcaatgatcagtgataaaggactcgatgctaaggagaatgggtggaaataagggcctggttctaaggccgctgtgtatagccatgtaggttgtgtgttgcacaattctaggaggcaccattgtcatagactgtaacatggttaggctgtggtcctggtccagcctctggtctagtctctgaagggaagggagtgaagggaatggcagaaagcttggaattctgtgaattgtgaattctcccaaatctctctagcaaccaaattgtttccataattctttatgacaaggcttttgaaactcaaaggctgagaattgatttcatcttctgctgtgtcaacttttgcctaaggcaatgagtgatgactcacctggttcagaccaggagagaaatccaggctgaaggaaaatacagggagaggggtagaattccttggttaatatttcaaaatcttagtctgcaacaaatgtacccataaagtgtgtgccaagtaatataaatactcttaatagcaaagaaataattctacttaaattggagtaggaaatgaggaaaagttggagaaagctccccagggagggtgacggttggactggactttgaagactgcatttattttggcaagacagggaaggcattctatacaaaggtctggcataagcgaagtcagagaggcctagtgtgcatggtacattggcagaagtaatcaagcgtggcaaaggagttgccaggagggaggttggggcaagggtgagaaagttcttgaatgtgcaactttcagggagctgaggaaaggatggagaagtcctgactgtcctctcacggacatccccacctggcctcaggtgtccgtacagccccttcaccttgcttgataagcaactgcccagtgctggccactctggaggagtcatgggagcccacactggctctgggagagtgtgtactctaggcgatggggttgcccctggctcatgggctcactgtctcctgacagcttggcccctggtgtctcctgggaacagcccttcttgcttaggccattagcacacccttaaagagggagagaactgccgtcagcagacctctggcttctcccagccatggctggggagaaggagcttcccaaggtgctttgcagctgctcctgtgggcccacagtgctctttctgcaccatcttggcactcagcactgtgtgtactcaccctggagacacagattgagccctgatctgtatttagtcttagtcacagtcccagtgtgggattccctcccctgcccaccccacccccacccttggaaacaagtgagtgggagcctttctcatctccgggggtggatcaaaactcccttgcccagagtgggtgggaagaatgctgagcctggggaaggattctggggtgcactctttccaagcctccctgcttcttcaatggatcatgaatcttaattccccatcccagcaagggctgcttccagagctgagagagaagctgtgtagttgggatcattgcagccctcaaggatgcactcaagccagtgaggaggagaaagaccacttgaccacccatggaatcagggatcattcctgaacccctttcactgtctatttggatagaaggatagaaagtaaaggtggtgatcatcttttgattctactcttatcttgcccaaatccccacttgctagagtctaggaagccaacaaccccttcatgggtatagattttcacccaacctacttcagtcaggtatgagcccataaagcctaggccaattcctgcttggttcccagcacccatttacctcctgatctctggtagggataagagtgtgttggggatgtattagtttttctattgctgctgtaataaatgatcacacattcagcagcttaaaatgatatctgcttcttagcttacaattttgcagggcagaagtcaaaattgaggtgtctgcaggctgcattccttgctggaggttcaagggaggatccatgcttttgttcattcaagttgttggcagaattcggctccatgcagttgtaggactgagggttctttgttggctgccatctaagggtcacattcagcttctagaggttgccagcattccttgattggtggtccccttcctccatcttccaagccaccaatggtgggtagcgtcctctcacagtttacatttctcctgtcttttctttcgttgcatctctctgagttgagcagggaaaggctcccagccacctgggtggccccagtctaatcgcctgagcccttaaaagctgggagcctttctctgctgaactttcacacttgactttgcaggtgtgattaaatttaccaatctttctgtctcaagatcggtaaccttaatcacacttgcaaagtccttttgccatgtaacataacatatcacaggttctggggattggagtgtagacatctttggaggccagtatttggcctgccatagagtgtgattaagagcttcatctctgcatcctcttcccctccccctcacaaattctggtcctttaacctcagggtgaggaagaagcccaggacacaagagaaaagccaggtctcttcttggcttacaggtgaaggtttcccttatttgaagttgtctgcacaacttcttcaaagagaggctggtttgagagctggaatcccactaggggtgttgaaagtaggaaaaagtgaggaagaactgaggttctaactaacctcagcctttatccaaagccttctccatttaccagcaacacagaaacaaacattgatgtgtgaatattctatagattcctctgcccagtatgtagcttcaagtagactatgaactctcctcccttgctggggagcccaggccagacaaccaggctctaggaaagcatttatatgtattaaagatgttcatatgttaaaaaatacaatttgggggggtgtttggaaatatgaaatattttcaccaggggctagctgagagccaggcgaccctgcaggaaccggttcatgggctgcttctgtgtaccctcccctgtgtgcctgctcagcatctgggccccttgacctcctgctctctggaagggtctgtcagtctcgcaggtagcaagcctgtaggatgcaaagcagtcaatctgtggacactgttaaggaccaaatccctagccatagacaccatctgctcccaggaggattggtgtttgtcctgtaggaccgacctctacttctaccccagctatatggggagccagggcagctctggcttctgggttgacctccacttcgggctcttgggctcccactgcttggggtgtgtcatcacctctcagactctcagtggtgtgattacactttgtgagcaagaaggagaaatgtcaaggtggtgccttattgggtacagggctagggaataagacctcaaagtatcccagaaacctaaacatcttcactaccaccaggggaggtcgagtgataagaaagactaatcagtactttctgggttgcttatttcaggagcctaaccttcacctccctactcaattcccttttctattctcaaccttcctgatatccattgctatccccaccttgcttgtcctagttctgatcctctttctagcttcactataaataacaccactaacacgccacacacacacacacacacacacacacacacacacacacacacaaaactagatatattaccataataaaaaagtcactatgttagggatccttaaactttggtttgcttaggggttgcttaatagcaatctggcagtggcctgagccccacccctggacattttgatctgggtctggggtggagtctgaactactctatttttaacaagctatatttttaacaactacccaggtaactgttgactgatgcagctcactgtctgtgacctggatgatcaggctgcagcctgacctccttttaggggtaggtatttttaagctgttttataagcactttgttctagtctctttcctttataggttagaaatacctctgatttgaaccaaggccagttcagtatttggtacagatcttaatacactggtaattttaaataaatacttacactggtaattttttataaatactttttaaatatcagaagtcatttttgcttgaaacaagcctttcaactctgaatctaaatagtcactagtggatgcaaattcatttggaaaggataaacattttttatttgttttcacatacagtactctggtgtctctcaatagacaatcatcaatttacattcatttattcaacactgattaagcagggacattgtattagtccattctcacattgctttaaagaactatctgagactgggtagtttataaagaaaagagatttaattggctcaccattctacagactgtacagaaagcatggcaggggaggcctcaggaaacttacaatcatggaggaaggcaaaggggaagcaagcacgtcttcacgtggccaataaaagagggagtgagcgaagagggaagtgctgtatgtttttaaacaaccagatctcgtgagaactctctcacaagacagcatgagggggatggtgctaaaccattagaaaccagccccatgatccaatcacctcccaccaggccccacctccaatacttgggatcacaattcaacatgagatttggttagggacacacagccaaaccatatcagatataaagatgaataatgactagatgcctttacgagaatttcaggccctgtgtgctctgatcctgacctgcacccccattgtcattttgccatgacaggaactcccagccctgcaccagccacacttagcttcttacaggtccttgaacttgctaagcttcctctcaccactgagtctttgtccatgctaatccctctgcctagaatgttcttccctcctttttctaattcatttctacttatttttcagccttcagctcaaaggacacctcgaggaatatttctctggtctcccagacctaggttaggttgggctcccacatcataagatctcttagtttttatgcctttttttttttttttttttgagagagagtctcgctttgtagccaggctggagtgcagtagcatgatcttggttcactgcaacctccgcctcctgggttcaagtgattgtcctgcctcagcctcctgagtagctgggactacaggtgcacgccaccacaccaagctaatttttgtttttttagtagagacggggtttcatcatgttggccaggatgatctcgatctcttgacctcgtgatccacccacctcggcctcctaaagtgctgggattacaggcgtgagccaccgtgcctggcctatgccttcttttaagaatagttttagccattcttatgtgcctaatgcacagtgggctctctgtatttgctgaatgaatagatgcatgtgaacatgtggatttctgaatcctcaggctgtcacatcctagtgggagaaacagacgtgtgaagtaaccatagtaataggtgctacaatagaggagcagacaagatttgatttgtcagggaaatcaaaacacaaagattgtttgatcagtaccacttgtgaggttgggccagggaagactttatacagaaggtgatgcttcagatgaattttgaagggcaaccagttttccaggcagaggagagggtatttttggctagaaaggaccatgtggtgatgctgcagggtggcctcaagcagttcactgcacctggagggatggggtttaaactcagtggcaggactccacccaatgccatttgggagccagatctctccctggaggggttggattgtgcacccccaaccaaaatgtccaagtcctaactcacagtacctgtgaatgtcactttatttgaaaagaagggtctttgcagatgtaattgagttaagggttctttgaaatgagatcatcctggattaactggatgggcccaaatccaatgacaagtgtccttataagaagaggaaaagacaaagacaatggaagaaagcccgaggaagaccatgtgaaggagaaggcagaggttgggatgatgcagccacaagtcacggatcactgaggattgccaacagccactagaggctagaagagaagcagggaacaaacggtttctccctcagagtctccagacggcactgtgcagagccttgccagctctgctgacaccttgatttttagtcgtctggcttccagaactgtgagaaaataaatttctgttgttttaagccactcagctcgtgataaattgttatggcagccacaggtaactaaaacatatcctcagtgctcagcccagatccagcatggctctgtgaccagcaacccgcaagactagaatccaaagaagggctctcccgagcatgggatgccagaccttcccctttggctgcttaacacagaggaaactgtggctacaataaacagagaggggtctttgtaaacaggcaaccggttggctgcccaaagtggacaaccttttcaggattgagaaatggcagtcttcttgacattttagaaaatcttttcctgggggatttggcttcacttcctgcttggatttgaagcctgcaaatacatttacaaagtcaagcatttccctggtggctcccaggctcttttcagcagggagagggtagtggggtgtcattggtgatgttttctgccaagaacgaaagcaaaatttctcctgttcaccaacctccttgcccaaagcaaatctgaagaaggctcttatgacgcacctttcaaaagaaaaaaaactttttagaaacgtaagatttgtttaatgcttttaattaaccagacatatagttctcttggcaggtttgtggtagggagaataatggctccccaaagacatctctgtcctaatacctgtcctaatatgttaggtcatatggtagaggagaattaatgttgcagatggaattaaatttgccaatcagctgcccttaaaataagattatcgtggattatccaggtgggctagatgaaatcacatgggttttcgtaagacagagggaggtgatatgagaaagatgcttcaaccagacatggttgcctttgaagatgggagggggcatgagccaaggaagcaggcagtctctagaggctggaaaaggcaagataatgggtttatacttagtctgcagaaagaaaagcagccaagccaatgctttgattttagcccagggaagcctatttcagacttctgacctcagaactgtaagataatacattcatgttgttttaagcctctaagtgtgtggtaatcggataggaaactaatataggggagaaggaggagattggagagggaattggtggtagttccttttggtgtttccaatgaggccaccctaatgggaactgttgatgaaatactggcctgagctaccatcagtcgcagaaggagattggtgataacaatctttcaaacacaattccactgccaagaaaactggcaggaccccctcccttccttccctgaagtggaaccagctcagactttctgactatagcaaagccccatggggttcttggttgggtatggccacatcctgactcgtgtccgtggagtacaaggatgcatgggagtctcctctcactgcccaggacagctggctctgcaggagggcactcctgtgccagccacgctgacctaatgaagccttcagcccctacatggtgtctggttcctcctgcaaaggatctttgaggcttccctgtgtctgcttctttctcttctggttcttgcaagctctcccaggcctcatgagacatgctggagcacctgtcactgctgggccacgtgcctgctctgggatgatttggagaagtagttgaacctgcagatatttcaggcatgccctcatgcgtcacttttcccaacagcttttgtcttcatcttctcaaatgtctctcggagcactggctcccagcctcctggcttggaattcatgagaacgatgctgccgaaatctgagcttgtcagcgatggccctgcctgcatggcccagcggcagaaacaggaggagaagagcttgtggaggctgggcagggcccagcagagtcaggagggctgggggtcactgcaactgaacttatgccagcatctctccagtgctatagaaaacccagggctccctgcaatctgttccagaaactccccagtgatctggttaactgtgtgggatccaaatccctgttccacctctcaccagttctgtgaccctgtgccagttgcttagattctctgggcttcatgtaccttcccttgtgtgaaatgataaaatagtaggcagacaataatcattagctataataacaattattatttctattattacctattggatccttcaccttccagagtcatgaatctcaatgttctctcagtgatattctccaaacatcttagaccctcccttcctagtgttctgtgtctatttctaacagttttattgagatatagacatccaatgaactgcatcttaacatgcatggtgtggtatgttttcatgtatgtgtacactctggacaccattactacaatcaagataatgaaaatatccattatgtccccaaattctgttttgtaatctttccttcccactcctccctgcctacacttcctgcccccagtcctcaaacaactactgatttattttctgtcagtatagtttgtattttgtagaattttatgtaaatggaatcatagagtatgtactctgttattgttttctttttcttttgaaacaagttattggtctgtcacacaggctggagggcagtgatgcaatcacagctcactgcagcctcggcctcctgggctcaagcaatcctcccacctcagcctcctgagtaactgggaccacaggcatacaccagcatgcttggctaatttctaaattttttgtagagatgagctgtccctttgttgcccaagctggtcttgaactcctgggctcaagcaatcctcttgcctcagcctcccaaagtgttgagatcacaggtatgagccatcgtgtctggcctattgtctgtcttttatttcattgaacataattatgttgagattcatccacattgttgcatgtatcaatggttcattcatttttatttctgagaacttgtctactgcatggatatatcataatttatgtatgcattcacctgttgatggacatttgggttgtttccagtttttagctagtttgaataaagctgctatggacattcatgtacaagtctttttatgaacatatgctttcattttcttggataaacatataggagtggaacagacaggttatatggtaggtgtaagtttaatgttttaagaaactgccagactgttttccaaagtggtagcatgatttacatttccaccagcagtgtatgaggcttacaatgatggcttcacttcgttgctgatgcttggtatgatcagtctgtttgattttaaacattcaaatgggatgtaatggttataattcgcatttctctgatgattgatgatgttgagaatgttttcttgtgccgtccatatatatcttctttggtgaagtgtctctttaaacccttttacctattttaaaaattgggttgtatgtcttattactgagttttgagagttctttatatattatgtttataagtcctaacagatatgcttctttgaaaatattatctctaagtctgtggcttgtcttttgactctcctaataatgtctatcaaggaatagaagttcttaattttgctgatgtctgatttatcaattttatctttttatggattatactttttgttgcatttaagaaatctttgcctaaatcaactttacaaatatttttctcctggattttattctagaagttttatagttctaagtttacgtttagctttatgatccattttgagtttgttcttgtagatagcgtgaggtgagaattggaggggattttttttttggcctatgaatatttaataagccaaatttgggcatcatttgtttaaaaggttatcatttccacaagtaattgcctttgcgtctttctttaaaatctatcagtctatctgttttgggtctacttcaggactctattttgttccattaatttatttgtctttctttataccaataccatgccttcttgaataccataactttagaagacttgaaatcagtagtgaggcaagagaatagggtctggaggcagggaacctaaggccaattcatgctgacttcccaggactgaatcaaaagaaaaacccccacctctccatatccatgtaacaaaaggatcagaggctattccctttgcaaccccttcacttttctgcattgcagatgaaaaacgaaagtacctctgattggtcccctcctgcaaccaatcagactggtctcaggccaagtcttcatgtgtaactttgtaacttcacgtcagtctctgattagttatcttccacaaccaatcagactggttgcaggccactacttcatttacataggatataaaccaagtaatcaatgggaaacctctagaaggtatttatactccagaaaattctgtaaccagacctcttgatctgcttgctcaagcatgctcctactctgtggagtgtacttttatttcaataaatctgtgttttcctttccttgctttgtttgtgcattttgtccaattcgccaagaactggacagcctccaccagtaacagtagtgtaaatcctcctactttgttcttccttttaaaagttgtttttagctactctaggtcctttttttgacttacatgaatttttgtttttagctactctaggtcctttttttgacttacatgaattttaaaataagcacgccaatttctacaaactgtcctgggcttgtgattgagattgcattgaatctacggatccatttaaggagaattgatatcaatattaaattatccaaaccatgaacatggcatatgtcttcatttaggttatctttaatttctttcacaggtgttttataattttcagtgtacagtccttgcatacctttttttaaaatcagatttactgctaagcattttattaatatttgttgatgctattgagaatggtgtaggtttttaaatttaaattttggattcttcatttctggtataaacagattgatttttctttacttattttgtcctacaacattgttaagtttgtttattctggtaacttttgaagactgcgtaagattttttataaggtaataatgttgtccataaacagagacaattttatctcttcctttttaatctgtatgtctttttttttttcattgccttatttcactggctagaatctccactacgatgttgaacagaagttatgagagtggatatcctaggtttttctgattttaggaggaaagcatccagtctttcaccactaaacatgatgtgcttaggtttttgtagacttttgttgatctcctttattaggttgtgaaacttctattcctagttttctggaagtgttcttttccttaaaaaaaaatcagaaatggatgtaagattctgccaaatgtttttttctgcatctatagagatgaccatattttagtcaatgtattttttttgagacagggtctcactttgtcacccaggctgaagtgcaggggtgcaatcagggctcactgcagcctcgaccttctgggctcaagtgatcctcccaccttagcctcctgagttgctgagaccacaggcacatgccaccatgcccaggtaacttttttattttttgagatagggtcttcctgtattgcccagactggtctcaagctcctgggctcaagtgattctcccacttcagcctctcaaagtgctgggattacagatgcaagccactgcacccaacttattcaataatttttaatgttcaaccaatattacattagtggaataaacccaccttattgtgatatatcattgttttaggctgtttgggctgctataacaaaatactatggactaggtggctaataaacaacagaagtttatctctcacaggtctagaggctgagaagttcaagatcaaggtgccagcagtttcagtatcttgtgagggtccatttcctggttcatacagggtcttcttgctgtatcctcacatggaggaagggtggagggctctatcctcatgacctaatcacctcccaaagaccccacctcttaatgctaccatttcattagttaggacttcaacatatgaatttcggatacaaacattaagaacatagccattttccttttaatatattgccggattcaattttctataattttgtttttgtttttcttttaattgacattttgtttttaattgacattttgctcttaattgacatttactagagatgtagattggtaattatctgttctcacctctgcttttctaatgtctgtctgactggtagcagtgtaataatgccttcatcactgaataaattgggaagtattccctcatctttaatatctagaaaagtttgtgtaggattggaattacttcttttttaagatttgatacaattaatcagtaaagccgtctagacttggaatttgttttgtgcatgtgggaatgtttttaactacaaattaaatttctttaatatatatagggttatctagattaatattctcttacccttttctagaatctcttatttatctctttcatccctaatattggcaatttgtgtcttctgtttttttttttttgtggctatagatttatcaattttattgatcttttcaataaataccgaccttttggttttattaatttttctctattgtttctccgatatcagtttgatttctgtttaccttgggtttaacttgctatttttttcttagttccttaaagtggaggcttagttcaatgacttgagatctttcttttctaacatagacagttaatgttataaatttccctctaagtattgctttaattgtatcccacaaattctgatacattgtgtttttatttttattcagttcaaaatactttctaattccctttgatttttttctttggcttatgggctatttagaagtgtatcatttagtttcccaatatttggaggtttcctagggatatatgttattgatttctaatcttatttcactgtggtgtgagaatatattttgtatgaattgactccttttttttttttttgagactgaatctcactctgttgccgaggctggggtgcagtagcgcgatctcggctcactgcaacctctgcctcccgggtttaagctattctcctgcctcagcctccctagaagctgagactacaggcgtgcaccaccacacgcctggcaatttttgtattttgagtagagatggggtttcaccatgttggccaggctggtctcgaactcctgacctcaagtgatccactcgccttggcctcccaaagtgccgggattacaggtgtgagccactgcactcagccaaattgactccttttaaagttactgagagttattttatagcacagaatatagtctatctctgtaaacattctgtgtgcacttgagaagaaggtacatgctgctgttatgtggaatgttctataaatgtcaattaagttgtcagttgatactgcttttcatgttttctatattctacacattatctttctactcattctatcaatttggacagagtgtcaaaatctccaactataattgtgaatttgtctatccttccaattccatcaatttttgcttcatgtactttgaagttgttattaagtgcataaatgtttagaattttgatatttcttgattaattgacccttttaccaatataaaatgacattagttatccctggaaatatttgttgttctgaaatctacttcatctggtattaacatggtcaccccaggtttcttttgtttagtgttagcaagtttagtgggttgaaaaatgtccctccgaaattcatgtttatctggaatctcagaatgtaacctttttttggaaatagggtctttgcaggtgtaattaaggtaaggatggagatgtgatcatactgaatttagtgggccctaaatccaataagagtgtccttataagagacagaaaaggatatcagagaagcagggagaaggccatgtgaagaatgagggggatattgaagttgtgctgcctctagccaaggagtgccaggagccaccagaagctggaagaggcaaggaagaattcttcttagagcctttagaggaattatggccctgtcaacaccttgatttcaggcttgtggcctccagaactgtgagagaaacaatttatgttcttttcaggcactaagtttgtggtaatttgttaagtcagccctaggaatctaataggacatggtgtatctcttaccattggtattaccattctgtctccagagaggtagaaccgagagagagacaggagcagggaggtgcgggggtgagagagggaggaggagggaaggggaggggaggggagggaaagggagggcaggggaagggaggagaggagagaagagggagagaagagagggagagaagaggagaggagaggggaggggaggggagaggagaggagagaggagaggagagaagagagagagagaagagaggaagagaagaggggaggggaggggaaagcaggggaggggaggggaggagaggagaggaaagggagagaagagaggaagaaaagtggggaggggaggggagcagaggagaggagaggagaggagacgagaggagagcagaggagacgagaggagaggagaagagagatttattaggggaattggctcttatggttacagaggctgagaagtcttacagaagactgtctgcaagctggagaaccagggacgctgttagctcagcctaagtccagaggtctgagggccagaggaaccaacagtgtaactaagtccaaggctgaacgcccaagaacccagggggctgctagtgcaagtcctggggcccaatggttggagagtttggagttctgatatccaagagccggtgaagaagggtgtcaggccccgaagacagagagaaagtgaactcacctttgcctttcctctgctttttaattctatcttggcctcagccgacggaatagtgtgggcccacattgagtgaggatgggtcttcctaacccactccatggattctaatggcagtctcttctggaaacaccctcacagacacacccagaaataatgctttactagccatctgtacatcccttaatccaatcaaattgatacctgaaattaaccatcacatcctccctttccttttaacctatttgtgtctttataattaaaatgagcttcttgttggcagcctatagttgtagcttgctttatttatccaatttgataatttttgcctttttctgggactcttagaccataacatttaatgtgattttttaatatggttagatttgatagagcttttaaactctaataactcgctgttttctgtattctttttcagtcttcttttgaattaattgtgtatttttaattatttctttttatgtccttagtagagttaccagttatccttttcttagggctgcttcaaggtgtatagtacacatttttaataatcacattccaccttcaaatgatattataccatttcatgtaagtgtaataaccttacaacaatatacttccatttttccctcccaaataccttgctatcatttttgctataaagagtcagctggctgggcatggtggctcatgcctgtaatcccagcactttgggacaccgagatgggtggatcacctgaggtcaggagttcgagaccagcctggctaacatggcgaaaccctgtctctgctaaaaatacaaaaattaggtgcctgtaatctcagctacctgggaggctgaggcaggagaatcgcttgaacctgggagacggatgttgcagtgaactgagatcacaccacagcactccagcctgggggacaagagcaaaaatccatctcaaaaaaaaaaaaaaaagagtcagctgtgctttaaagagattaaacaagataaacagtctatttagacgcatagttatatcctctccagtgctcttcattcctttgggtagggacacatttgtatctggtatcattttccttctgcctgaagcacttgctttaacgtatctgtagcctgcttgtgataaattcgttcagcatttatatgattttaaaagtcttcatttcatcttcacttttgaaatatatttttgctgggtataaaagtctaggttaacttttttttctgtatttttaaaatgtggtttcactcttatggcttacattgtttttgattagtctcctgccatgtttatctttgttcctctgtacataggggtattttactccagatactttaaagatttcctctttctcacaggttttaagcaactgcttataatatatggtgtagttttcttcatgtttcttgtgcttgagtttgttgagcttcttgaatatgtgattatatagttttcatcaagtttggaaaatttccagccattttttttctactttttttttttcttgtcttctcctcctttgggagcttcaactgcctgtgtattgggcttcttgaagttgtcccacagctcactaatgctttgtctgtttttcagtctttttttctctcagtattttattttagatagtttctattgttatatcttcaaattcagtattcttttctctgtggtgttgaattctatccagtttatgtttcgtctcatacattgtagtttttcatctctagacattgctttttttttttttgttttctatctgccacgtctctactaaacatgcccaaactttcttttcctctggcttcttgaacacatggaatgcagttataataacttttaattcccccatctattaattgtatcacctgtgtcatttctgcatcagtttcaatttattgattttctccttattatgcatcttattagccaacttgttttcatatttaattttttattagacatcagacgttgtgaatctgacttgttgggtactgaatatatatattttttattcttataagatccttgagatttattctgggattcagttaagttacttggaaacagtttgacctttttaggtattgcttttaagctttgtttgaaccagaaaagaatttattctaggactaattttgcccccacaaattaggtaaaatccttttgggtctcttacccaatgcctcataaatcttgaggttttccaatctggctgttgaaagcaagaaccatttgcagccttgtgtgatctccaggaatttcccccctaatctttattctttccctggtcttgggttgtttcctcacttatgtgaactgatgagaagtagctgaagactcaaagaggactctctatagattgctggagctttctgcctgtgtagccttttatttttcattctctggtgtgtgaattctagttgtcttggcaccccacctccatctccccatctcaaggggacttctgggttctgcctgggttcccccttcttgcaacgtggcctggcagataggtggggcaattgtgggactcctataatttgtttcccatctcctaaggatcactgttcttccagtatccagtatcttgaaaactgctgtttaatttattttgtctggaatttccttagttgtttcaggtcagaaagtagctggcaacagaagttgtacccttgcctccctctgtatccattctcccatatcctcctatgcccctcaagccctgctactgccaagaaatgtcatttatttagagcctttctatatttcagcagcaggtaatatgggcagcgactggttatatgtccctggagtcatatatactggggttcagatctcagctctgccagttcctgtgtagccttggccaaattacttcatcagcttgagcctcagtttccttatttgaaaaagagaaaatgatacctagctatagggctgttgtgagggttaaatgaggtaatgcatagaaggtaagtagcactacacgatggcatccataatataattcaatgagtacaagcaggatgagttttttaaactgcctcaaatttctccattgtctgctcctgcctctgttccaggggacaatcccaccattcctcttaagctcctggaaaggggcgtatgaccggccctaaatttcttgcaccaacagaggggagcagtcatgtggagaacttccaataacacatgcagcacatcatggacatttggccgcacgaagcattataatgatcttttctttgcggcagattgactttactaattaggttgggttcgaaccaatgttaaatacagtttgcatgtacagaacgcaaaccaactggcagcaacagggaactcagaaacatttcaggtaacaggacaagccagctatgattaaaactttgcttcagataatcctttctctctcccttggcctccatttttatgagctcagtaaatattgaagatattaaccctttatcatatttgctacaaatacactttccccaagtgttgttcaattctgttttgaaattcaaatctgtctcaaacagaattttaaaatctgtgtgtagttagactatggatcttcccttttctaatttactctactgctttcaggcctaggaaaaccccttccaatgactgaataaacatccacctttattttctgttttcaacattttatttcttatcctaactagaatttattttgattttaatatgtggtataaggtgcaaaggtgttggtatttgagataattaatgccagctgctacaatggccaaaccctgaaatctaatgccttaacacagcaaagccttaggtttcactcacattaagcccagtgatgtttggatggcattccttgtttggtgctcttccaggcagtgactcagggacccaggctgcttctacctgcaactctaccatcttaaagtcttttgtttccagctggggggatcccatagaatatttgataagcactatctgtctctgccgcaagacttaactggatttttcaaaataactaatcaacaattacatgacccggaggcatttactaatcacatattaagttgttatatgtgtactatggtctgactgcttatcttgttctatcaggcactgtaccactttttttctttcaaactagttttatatatgtcttcacatccggtggggtgagctcttctctcattatttttctttatcaaaatgttcttggctattacatcatagatcatattacatattgcacatgatctcttagcatatgagactgcactcactgcccagaagctcagctaacatctcagttagaggatgtcaaaatccatgtatccatcttctaccccttttccaaactccaggcccacatttccaggcacctgatttgtagttggaaatacctggaaatttggccaggtctggtgggagctagagtacacagcagccaatggctgattttttttaagtcagaagtagacataaatcagaaggaaaagagccgatgctttaaaatatttccccatctccattgaaaagctcaggaaataataaggcgtgataattctgggatccccttactcaggagggcctaccgcatttgagaaaccttgagcaagtcgtttcagtccttcatgagtctacactctcctcactgtggctgagttgaggggggaggaagagaaaaagcacagtaagtggctggtggtagtagctcagagcaacggttcagaggttggccccagatgccagcagaggtctttaagatttgagtacccttgcacaatatgcagtgaaggacagatgtcaccaaaacaagaataatagtaactactcccagtttttgagcaccgactctgggctggtcatctttgaacataaactcattagaccctcacgactaccctgcaagctaagcaatgttacctctagtatacagatgaggaagcttaggttcagaaatgtcaagtctcttacccaaagccacagagctaatgaggaggaaaaccaggatttaaacctgggtcagctgactccaaagcctgtgccccatctactcagctatgctgtatctgccaactttcaaaatagtagggagatctggaatgttgaatagctcatgaacataattaaaactggccttgaacattttttgcagttgtgtgggaggggtgatggtccgtgttaactgtgcagtggagggagaatttacaatactctccctggatcatgctgaagaggagtaatgtgggtggtgaactgggaaccagttgtccagaacaaccatactgagtttctggacactagacagttgcttattttgctctttgcctcaacagatagaccggctattaaggaagaaagccatcttctataacatacaacacaatggaactgtttaagaaattgggatgggtgcattgactcgtgcctgtaatcttactttgggaggccaatgcgggtggatcgcttgagcccagaagtttgagaccagcctgggcaacatggtgaaactctatctctacaaaaaataaaaaaaaattagtcaggtttggtagtggcatgggctgaggtgggaggactgcttgagcctgggaggttgaggctgcagtgagccatgactgcaccattgcactccagcctgagtgacagagcgaaaccctatctccccactgcccctcgcaaaaaaaggaagaaatcttaatgaaacttgaactgaacttgggctagaagaaacccgaagtgtgaagcaggactaagaccaattgctcttagtctcctaaaggccaaataagaagcaaaaagcttttatatgtatcaaaagaaattatctgtcttctgaggagacccttctttcatggcattcaaacttcggagtattaggcttttaaatgcagaaaagcagtagtcctaattaggcatcacatgattctgaccaatttgaattaggaagcagaaagaagctcgattgatagaggatattattgcaagagaaatgcttgggagacagtgtggagtgaatctaggcctggcctgccccctctgctgccctttggcatcaacctatgtcactcacatagttaaggagagtctcagacaaaggaaatactctaccatgattgggatttgctgagcacaagtctatttccacagtgtttcaggcacaagaaacaattatgcattttgctagagtgcctgttgccttaatgattacatccatgtgtattttaggagaacgtctgtcttctgcttcttattcatttacactttacacttcaaaagattgttttgtaggagctactcaatgcacaagaagtctcatgagtttttcttctaaatgagccagcaactttccaagaatcaggaagctgaaagttgccaagaataaataaatgaactccagaaggttcaagtttggtttaaaaactctgtaaggtttaaagtaggttctatatctggcttaactccatgtcctcatctaagacataaaccacaggagggaatactcctcctggcatgtaactttttcccaagcattccatctaatagtcatttccaataatgattgattggaaaatcttagcaaagtagtcctaatgcaatgctataagcagaaatagaggtatggtggaatagctcttgcctgacagttaggcagcctctgcctcggttctgccacaaaattttctggacaaggtaaagcgtgtctctctgtgcctcggtttcttcatctatgaaatggagaaacaacactagatggtgtctaaaattcggtggtaacaattccaaatgaacccttgtctagtccatggaagcagggagtctgggacttcagtattattgatcaagattggaattagttggttgtgttcatgtccaactatgaagattaaaaaaaaaatgagtaagctggtgacagacatgtcaaaagaaaatatgtgtgattgagaaaaagtaaggaggtacaatagatattgttggtgtctcacctagacaccctttaccgagccagtgctcccatctctgagctgctgtgggtgttggctgctaattgcacacatctgtacccttccctggaggctggaggtgtgggaggttacaagacccctcttaccctactctggaggcattgtggccaatagctgataggtgtgtggggggggtgtctaccagcccagccctgttgcctctgggcaggatgaccttgatggtgcactttgtgctccagggcaccccaggggatcaagctgtggctggatttcccctgacattctcactgagctccttcccctaccttctcctgctcctctcactcccctatgggtttctcctgagagcactccctcaaaacatcacttgcctaagaatctccatctctgactctgcttctagggacctgacccataatgaggggaggaagaaagtgagccaagccagtaacccatttgtgttatgagaaacctcctgggctcgtatgtcctgagcctggcacagagcaggtaatgatggagactgcagggttgcaggacatgagacagccatgcacacagagttttgtggtctgggtaggaatttcatgtctccatccattcagcagccattcactgagaatgagtaccgtgatgggtctgggtctgcaagcagcttggctcagtcaatttggttgatgctgtaacttgaccaagctgggctttgctgctgctgaggcctcagaagcaggccgagaaagggaggggacaggcattgtagcagggtgtggatggcatacattcttcccaggggatgtctgaatacagtactagggaatttgagaaggaggaatgatgacattcatctggaagagcacagaagacttcccgaaggagatagcatttcttccgggtctgacggatgtgcctgacttaaaaatgtggaaacatgccgggcagagcattctaggtggaaaaagagtctgagctaaatggacgtgctcttctctccagtcttctcctgtcttcctttcacctgcttcaaggtgggactgtgatcttcccccacctttctgatggtgggccttagagccttaggaccttgtccagggagggtcccaccctatacactgggggaagggacactgacatcatgaagcttccataaaatctcaaggggactggggtcagagagcttctagatagctgaacacgtggaggctcctggagggtggtgcccagggagggcatggaagctccgcgccccctcccccatacctcaccctacacatctcctcctttgtaatatcctttataacaaatcagcaaatgtgagtgttgccctgagttccatgagccgctccagcaaattaattgaacctaaagaggggatcatggagaccccaacttgaagccaggtgatcagaagttccagaagcctagactggcgactggtgtctgcggatattaggggcagtcttgggcactgagcccccagcttgtgggatctgacacactctccaggtggatagcatcagtaattgaattggaggacacccagctggcgtccactggttggtgtgtgtgtgggaaacttttggtcacagaagccttctatgtaggtgactgttgccacggtggtgtgagagcagagaaagaagcagtgtgaagagagtgttccctacacagataccaaagtaaaatttcaactttggttatgattcacaggtttgagactccatatgggaactgaaactaagatcccctgggacttggagccccaggatctgttttcctcctggcggaagctataagtcccctgtgagctctctcaagcacttcccaagatgcacgccctctgctatcaccccgtgtgatggcatagatgacagtaggggactcatcagggagggctccagatctcgggcctcacggggaaaccagggctatgctaagtgatggggagagattatgaaagctcccagaagataaggccccctcctgagcaagggcgggagagaataccatgggcctgaaagtcagggtgttctcaggggagacagagagctgagacggcagctggtgggaggcatgagcagatggtgtgcctcgctgccggagacagcactgcgatcgagacaaagacgcgtcctggagagaggaggatgcctcactggcccttctgcaggagtccttggccaagctgggaagagagccttctggcaggaagtgggatgaaaaaaaagggatactggctttctctagttttcatccttagtagagtcaggaagcaaagagagggatggagagtgtcaagaattgcaattgcttcatgccaaggtcaagaagggtgcctgttgcaccagaacccctcaggttgtcttgcaggagaggtgggagtgaagggaatgaatgacgagggccaacctgagctgggaaggcgaggggactggacgaagattaaggccagtgggctgaatggttaggaggcttatgtcagcatatcttccaatgtgtggagttacgccctcaggacttaagatgcttttctgaagacaatattacacaatttttacatagcaaatctttttctttgtgatttctcttaatattcctaagttttgaaaaccactcccttcaagaggtttgattcgtatttgattttatgttctcctagttcactaaaatttgtaaaattaattctctaaaatcactggaattaattttggtgcatagagtgaggtgaggacctcactttaaaataatctgtaactctcttattgataaaaaagaaaatgatttatcataatagcagtaattaggaaaatatggaaacactgaaagaagaaaaaaacatcatgttctcaccacccagaaataatcataatcatttttatacattatcttttctgtctgtagttttacatgattttgatcatataatacatgtaaaattataaggctgattttaaaaattgcatccatattgataaatgtaatatatgcttattagagaaagtttggaaaatacataaatttatgaagcagaaaatgaaattcagttgtatatattttcttaaatataatttttgtagctatacttgagtgtttttcaaatcactgagaccatacagtatatgctgaactttaagcattgtgagtacatattaacagattccagatggaaaaaaacatgaagcaggacatggaaatttactatctatctatctaatctataactgatctctatctgtatctatgacatctgtggtttattagcctttcccaaataacctattcaatactcagtttgctcaatgtgattttttttcaaatgcttctgtaatattttatttcttaaggtttataagtttcttaataatacaagaaaaactgtttcttggattattactctttttttagtattattacttttgtaattaacattttggagttattaaaatgtgtgtagtttctttcaaacttttaatctgacaataatttctaacttataaaaaataaaaatagaataaggaacactcatatatcttaatttatttattgataacatcttaaactcatttgctttattgtgtttttctctctctctctctctctctctcagaatatttttctgggaaacctttgaaggtaagttatagatcatggtcatttacccctaaatactttggtatttccaaagaatggagatattttctcacataaccatggtacagttatcaatttcatacatttatgacttgcattgatacaataattttatttaatctactgtccatattccagttttgtcggttgctctgataatgtctgtaatggcatctctctccttcagcacagaatctagtctagggtcaagtattgtgattagttgtcataatttggaacattttcacagctttttttgacttttatgacaatgacttttctttcgagaatgcagtccctcccacctacatttttaactaggatgttactcatttatgtaaatgtttcattttgattaaattatggctatgtcttcatggccagaatactgtattggagatcctgtgtccttttcagggtgtcacatttggaagcacataatgttcactgatccctcatagctgtgcttaattttgatcatcctgtcaaggtgtcatcctatttctcccactatagaattagtttcctttttttcttcattgcaactaataagtggcctgtagatagacactttaagaccatagaaatattctgtttctcatcaaaatttcctctagaattagtatctactgatgatccttgactgatccaatctttagcatgatgattacaaagtgatggttttctaactccagcactccttccacattcactggtggacttctggccttcttcaagagacctcccttctctcccatttatgtgtttactatttgttatttatcattttcagtataggctaattattatttttttcacaacaacctgtttataacacattattgtatttaagtattttggtgttcagggtgtcccagagatggccagagggagccccttcaagctggctcatgtccttgtgaactgcttccagcattcctcgagcactttgttactttctggcacaacgatctgctctaggcttatcttgtacccatcctgtcctagccctggaatcagccatttctccaaggagctaggtatcacatgctgggttttcagaggtctgcaagacttgttacaaaaattacagtcattacgctttcccttaatttcttgcttctctggagcaaccacattcaactctttagctgattccattttcctctaaattattaaataacatgcttctactgctacttcaagattttttcacaagcacgcatattttccatctccttatgctctcaattcatttacttcataaatttggttacattaatattcaatatttataatattttgatgatgtaagcattattcatagctgaactatgagtgtcctataattaaggctacttttcctttcctgaataaggttttatttgccctggaatgacctgtcttaatttttctatttgcttagtttttttgtgcattattatcaccaactcaagcccaaattctcagttgcttccccaaatctgctcacggtatctccagatgcatcagcaatttattcaagttcattttcttgaagtacctgcccctgtagccctctgacctgctctagtttgagctggctgtgatacagatgttatctcgggttcttcctcaccatcatctggggagttccctcatttccttcctagatactccagtctctgattcccactttttttttttgaggcaggtctccctctgtcacccaggctagagtgcagtggcacaatctcagctcactgcaacctctacctcctgggctcaagtgatcctccctcctcagcctcctgagtggatggaactacagtacaggcacatgccaccaggcccggctaatttttgaattttttgtagcgatggggtttccccatgttgcccaggctgaccttgaactcctgagctcaaggaatccacccacgtcagcctccaaagtgctgggattataggcgtgagccactgcacccagcccccatctctttctacatttaatcttttgttttgatgaatcacaatctctagtagtttcctaactactaatattctaaaaagaatacataagaagtacatttttgagaccctccatgtctaaaaattcattataccctcatcaataatcgactatttggctagattttaaattctacatcagttagaattctccctcagaatttttgaaagagtccctgtcttctagcttctaatgctgtaaccaagaagcctaaagcaattctggtttttgactattccccctttctagaagcctttcctttttgtctttagtttctgaaattttgtcacgaggtgatttagtctgttttcatccactagatattcaatgggctccttcaatctggaaatgcttagcctccagttctggaaaattttcttgaattatttctttgatgatttttttcctctctgttttctttcttttctctttgtggaactcctataatttgcatcttggacctaaattgggccctaattttattttctattttcatccctttagttttctccttctactttctggaagattttcctataattttccaattttcctttttcagtttaaaaagtttttactattgtagttttaatttacaaaagttcttttttgttctctgaataatcttttcctatagcaacctttcttgttttgtagatgtatcatttttgaagaagatatctctgaagattaatggtgagattttattttttaatgttttcttatccataaaaggtctgttttcttcatcttgcctcttctatgtgttttccctaggcctctgccttccatattacatgctttccttcaatgttcagtgatccttggctgtctcatgaattatttttcagtcaacctcactgagatataatttgtattttcattccattggtataatttacatacaacaaatgttctaattttaatgtaaagttcaatacattttgacatgtattggcaggtatgtgacatacattggcaggcatgtgaaaaataaaatgtgacccccaccacaatgaaaacatgaaacacttccattacccttggggcccctttacagtccccctcccactgcccccacctccagccccagggaccactgatttgctttatgccattatatattactttagctgactctagaatttcatgggaaagtagtatatctaatgtttttgaaattcaatcatgtatgaatctgtggtttactttcctttttattctattctattaattaattctattatattaatataccacaatttgtttattcattcatttattggtggacatttggcttgctttcagtttggagcacaaagctgttatgaacattcatgtacaactctttatatggaaaaacatttctatttctcttggctaaataccaagttttgaaattactgttttatggcaagggtattcataactttataagaaactgtcaaactattttcccaagtggttataccacttttacactctcatcagcaacatgagcattcttttttttttctctcatttggcaacagtttattcagaggtatgtaaggtagaaatcaaagctggatggcaaggcactgttgggagctcctctcccatgggagtagttcttggagcagccatgcagcagccacaccacttcccaggcttctcaaatgatgtttcaggtgtgaagcaacaagatccacatcaggcaggtgtaagaatcaccctggcctagaagctccatgcaccacagtagccaatatcttacaataacttcatagacacagctttcagggtccctatggaggcatatggagttacaggagtcaccacactcaggggaaccaaaagctatgatgtcccaatcagatatgatgtcccaaatgattgtcccaatcatttatggttatcctgagtccagatgcaatttatccaataggagttatttctaccaaaagtaatgttgcctagagacattgttgacattttacctttatcaagttattagaggaacagagaaaggaaggtaagtgaaggtctgtaaatgacgagttaatgggtgcagcacaccaacatggcgcatgtatacatatgtaacaaacctgcacgttgtccacatgtaccctagaacttaaaagtataatcaaaaaattaaaaaaagcaatgtgagcattctaattgctctgaattttcatcaacagttggtattgtgagttttttaattttagacattctagagggtgtgtattgttacattatggttctgatatgcatttccttgataattaatgatgttgttttttcatatactgtctacctaaaggagtagggcactgaaaagctggttagacattcaggccagtggaaaagtcttgtcaactgagggtttcacaatatagtggtcctcctgggtcattttgcagagaatcctgttattaatttcttagtttttctttttctcttagagactagttagagtcccatagaagtttctcccagtttccttctggaagtgtgtatatggtttctagaattctgaaatccaggtgtgagaagaaagctagatgcatcagcttccattatctcatccttgccttcaattgtgtctggtattttttagcctagagaacttgttttgtactctccagagaataaccctacagttttctacagagtgagggagagactgctccctagctgagctgagtggatgagggtatctgggggatatgtgcttctttaacagactttcacccacttttctcttttcagatcaacttttactcctacttcccaaggtatctggtgctgtctgtatctgagcctttgggcattggataatgtaaattgactagtttctcagctattcagcttccttgattgtgaaaaaggttgctatgtcactatgtgcggctccactgttgtaaagggaaagataaaagtctttagtgattctcccagcatagaataccaacaacataaaggatgtgacctctgttagtaagaactggaccagaagagaattgtgattgctcaagagccatcaaatagggcaagaaaaatggcaaacagagttctcacatggcagagcttgaagaaaacagcagaaaaccaagggaaggactttggggtctggctttgccctcagggtactgaagaccactgaatacatgcagttcaaccgaatttgggatctaatttaagaagacttgccaatccgttgatatcattacttccacttaaatcaatatatttttttggagtagttttaggtttacaaaaataaaaatgagaggaaagtaaagagagatctcctcactcatatatatccctttattcccaccccaatttcttgtattatgaacatcttgcattagtgtgatacatttgttacagttgatgagccaatagtgatacattattattaactaaagtccatagtttactttagggttccttcttgatgttgcacattctacggactttgacaaatgcataacaaccatgtatctgccttaaatattccctgtgtagcacctattcatgcttctctccctccctcttcctaatctcctggcagccattgtctccatagtttcaccttttccagaatgtcatatagctggaatcagtcagtatgtagcctttttagattggtttctttcacttagtaatatgcatttaacattcctgtgggtcttttcatggcttgatagctcatttcattttagtactgaataatactctattgtctggatgtcccagtttatttatccatgcacctactgaaggacatcttggttgcttcgcagttatgagtaaaggcactataaacatttgtatgctttgtggggacataagctttcaactcactcaggtaaagaacaaagagtgcaattgctggtttatgtatagttttgtaagaagccgccaaactatcttcttcccccatttgtttttgagttcttggtttggtttgtcttgaagtctgcaggagcacatctacgggtaatttttaaaagaaggatatataagaaggcgatgttgatggtatattttctaaaaatatctttccatggcctttatccatagaagtcacggtggccacgcttaaccatgttgtgtcacaaagctttcctctcaaatatttgtagctattactgtcatgttctctggcatttaatgttgttgagtctgaggtcaatctaattttgtccctgtagataactgattttgtgtgcctatatccttaaaggaatctttgttagtagaattcaagagtgttatcaggatgtgcccagatgctgattctctgtgttaccttttgaatgtaggaaaattttccaatatgcaggcttaggacattttaccacttagggaaatctttttagtgggtcttcaattattgcttatttcaaatgttctgattgttgccttgaaaacatctaatttacttaaggcagattcctaatatatatatatatgaaatatttataaataatgtatattataaatatatgtttctaatatatatttgtaaatatatattcctaatctatatacatatatattatatatgtgagactctcatatatatatttatatatatagtgagactctcctatatatataatatattatatatgtatatagattaggaatatatatttacaaacatacgtctcactatatatatatatatatatgtatatagtggactacaggcacccgccaccacacccggttaattttttttttttttttttttttttttgtatttttagtagagatgggttttcaccatgttggccaggctggtctcaaactcctgacctcaaatgacccacctgccttagcatcccaaagtgctgggattacaggtgttagccagtgcgctcagccagattcctaatttttaaaatcctccttgtgtatctttatcattttcatgactttctttttctcttttaaaaagtttctcagattttttttcgtccttgacatcactatttgggtttctgagggtcaattctcttttttactgtctccaatttgaatttgcacacaggtcattgcatttcttaaaaattttagtgcttcctttggatatgactttctgctcaagctttagagagcagaaatgggatgtcttcttgcatgccttaattaaggatgccaagtgattttctattttttttgatttatttttattaaaatactgacttttatttcacatgtatatttttgtctccccaccatttctatgtctgaccactgctactactatgtcctatcataacattccatacatacttaaaaccaagcaaagggtggattttcatctttaaaaactaaacaggcattttggacaacacattcttggcaatggaacctggacaacatttatcaaacatggtagggaaagttctcactctgcattataaaaagtacagccagatagcaactgttagagaaatgaagtaagatggaaaatttttaacaaattgttcaaacgattttcttaaagagacttcctccactgccagagatcttgaatagcctcctggtcattcatccagagacaattctttacataattgacgaacttggcttccattttgggaaacaaaccagctttttctatacttgtttgcatttttgctttaatgtcttctacagaactaggcccttttggtgttttaggaggtttttttttttcctgtttcttgaaggtttcttgtccttttgatcttggtgttgacggttttgagtcttttccattctgatttgacttctgtgcattttcggctggagcatctttatagatttcttcaccggtgctttttcttcaatatcctcatcatcaaaatcttcttcttccttcttctccttctccttcttattcttcttcatcagcggcaagttttacttgtttctgtggaaccttgctaccacctccaggggcatcactttccagatatacttaagagtttcacatcctccttctcttcgtcttctgattctgcagcttcctccacagctactaagtgctgtccactaatatgcactggccccgaaccaagcttcaaccataagaccactggtggtgttatttcaaagtccccaagggaaaccgttgactgtacagacattttcaaagttgtcagtcttactttaattggactgtcttcataattcattgtttctgcttcaacaatgtgcagttcatcctttgcaccagctcctaaactgactgttcctaaagataactggtctcattttcatcattatccaccttaaagtgatcatctttgttggcctttagttcgcaaccaaaaagatagctctggggcctcagggggctcatgtccatgtccatcgaatcttccttgggatggtggcacacccttaggtgggagagaaggtggatggagataaatgactactgctccagagaacagccatgcaggatggaatcacaccagggatttttttcctgatttctatggtgaataatattctgctaatcttatgtttttataagttctacaaaggccctactctacaacccatttggtttcagttgacagcaggtgaacttgcacagctcagcccatggctagctgaatctcataaggtacagtccctgggtcttctatgatggagcacaccaaaaatttcaatccccaacatgcattgttaccaggactcctcctatctcagactctgcctgcagtgttctgtgggagcagtgtgttgcaagaggaaagcaccttcaccagcatctttcttcccctccgtcctgttctggtgttttctagaaattggaatggcatgtgaaatggtaatcactagtgcctggctctcatgctcactgaccacgcttctcccattgataagtctcctagactagaatacaagatgatatttttaaaatgtctttaatgatacattttatttctttaaaatatatttgttgagcacttcctttatgtagggtcctgttgtaggcaataaaaatagagcagtgagcaagaaaggcatggccctgccctcagggagcttccatcctgggtttggttgaggatgaataggaaacaactgacaacataatgaatgactgtaggtacagttgtgattaggggttcagagaaaacatccagaccaaggagcagtggtgttggtggtggttcccgcatagctttccctgaataattggtgttcgagttgagctctaaaagatcagaatgaataaacaagaagagaaggagagttaggatgtttcaggcatagatcatataccaagagcctgaggcaggaggacatggtgggtttgagggcattgtagaaagtcgatgtgtctggagcttggaggggagaaacaagaagaggtaaagtcgtgttcattgttgcaaccccagtgcttgggtggagtagggggctctataaatgtttgtgtctgatgagtggaagatggtagttgtagctaatctgtaaggaagttcctgatggtgggtgttgggctgccctcagctctttcttgtccttacatttctaccagtaattagagtgacaatgcagaagccatgcccagtcggccaggagatgaggacatgggtcagagtcagagaagggctaaaaggacaagcagcatgtggctgaggccaaaagggaaaggaaaccacatggatttgaagcagcttggaaaggtttgagatgggatagctttggaggcaggtcttgaggagtggaggaggaggaatcttaacaagtagcagcgaaagaggcaaggagtaggagaatagaacaaggtgaacaaaagccccaagaagagacactgcgggtgtggtggtccctctgggctgcaggaccagatgtgtgcattgtggggaggctggatgctgagatagacgaggcagcatctcagctgcactcggtcaggaagaatgtgtccccagaatagatgtgcccccttcttagagcccatcaggataaagcctgggtcagccttactctgtgcacctgcttttcacattcaagcactgagtgaaaagtacctgcatatgtctttgggtggtgaagaaaaatggccaaaactgggaagccccaaatcttcaaatgcagactttgcctcccactgcttctcagtgaacttgagaatttgccccatctcatcactcagatctcatcagctctgagacctagtaaaaactctcctccccaagtcctagagaaccagaacaaaggaaaagaggacagactccagccctgactgcaaaccattagttttgataaacatctgtgttggtggcgccagggctattcattcaaccaacatttcctgtgtgccttctccatgccatgcacacaggctggcatcaggcggtgcagctatctcttttgcactgagaactgtcataaacaacaccatttaggacaagagacatccaagggagcagtctctgaggaagtggcttggcttctctgagcaccctgaagtcttgggcattcattcactcttagagggagagaatggctgggaactggggaagtgaggcttcctcagagactaagcagccacgaggctgcagctcccctggaacaggcagacttgcacaaactccagtgaattagaagtgtaaattgaggagttcgacttggcttgcacagtacaataaagatctgcaaacactcagctccgtattgaacctgaggcagggtgattaattcattattcgcttcccagcttggaagcaaaagcttgtatacccaggggccagcatggatcagcagagtcataaatcacgccacttacaagtctagcaatgagaaaatccactggctggaggggggatgctcttcaggcagcaacagcggccagaggaccggccagtcaaggcgggccagtctgctctctggagacagaccgattggccaggcatttcgccttccagccaagacggccagcctctcggccacccggcttggcgtttcctggccagaccacaaggaaataaactccactccacccaagaggaatgctcctgtgacctgaaatggcctctctcaaatgtagacaaagtactaggaatagcatcagtatctctccaaaaggctgctattgtccaattgggataaaccactctccaccccgctccttgggctgttctgggttccaagtccttctgccccagccagagggccagcctggtgtctgctcagcatcctccaatccaggtccctggatatcatcggctgccaaccctgagccagggcctttgccctccaatctctgctagcttcaggacaggacgctttggggatccgaatttcattgagagttgaaaggtaacagccagcaaagggctctttagcccctattcgaatacaaggtagctctttaaatatttgataattctttctcttccaagtaaaacaccctaggtttcctcaattattcctcatatttcaagatttctaaagccccttcaatggccaggaagtccttccattttgatattgactatttcccactttacatttcctcttaattctccaaaatctcggaaagggacccagcacttcctgtgtgttcttgttcttgtcatgagagaacaataacattaagacttattatgtgccaggcactttatacttatcatctcatttaaactttcatgatgagctggtgaagtaatttttaactccagtttacagaggaggaaactgaggcttaaagaggtaaaacggcttgccaggattgaatctttggtcagcctgacgccagagattgtgcttctaaagaaccttatgatatgctgtctcctttacccacagcctgacaccctgacatctgattcagggcctgccacacctggtaaccactttccctggagccaggctgagctttgagagactggccaaagctcttttctttctttttaaaaaaatttttatttggccgagtgcagtggctcacgactgtaatcccagcactttgggaggccaatgcaggaggatcacctgaggtcagaagttcgagaccagcctggccaacatggtgaaactccatctctactaaaatacaaaaattagccaggtgtggtagtgtgtgcctgtagtcccagctacttgggaggcagaggcaggagaattgcttgagcccgggaggtggaggttgcagtgagctgagattgcatcactgcactccagcctgggtgacagagtaagtctctgtctccccccaccaaaaaaaaattattttgaaacagggactcgctgtgtcacccaggctggagtgcagtggcgtgatctcggctcactgctcactgaagcctcaacctgctgaactcaggtgatcctcccatctcagtctcccaagaagctgggaccacaggcacatgccactatgtctggctaatttattgttatattttgtagagatggggtctccctctgttgtctaggctaagccatgtaattgctatccaattcagcatcaaaaaaaataataaactaaggtaaaaaatcaataacagcattgttcatactgttttccacccactacctgatctgagcatcccttcaaataaagacagaagtccttatttctctcattcttcttgccagaacagtcatatggcccatgatgcagtctctttacaacttctttttgccttatttgatacacagaggagcagcgttctccctaatctatttatggagcaaaagaacaagaaaagaggattctggccgggcatggtggctcacacctgtaatcccagcatttgggaggctgaggcaggcagatcacttgaggtcaggagttcgagaccagcctggccaacatggtgaaaccccgtctctactaaaaatacaaaattagctgggtgtggtggcgtgcacctgtagtcccagctactcgggaggctgaggcaggagaatcacttgaactgggaggcagaggttgcaatgagccgagatcatgccattttgctccagcctgggcaaaaagagtgaaactgtctcagaaaaaaaaaaaaaaaaaaaaaaagaaagaaagaaagaaagaaaagaggattccttaataagagggtctctaaccaagggattactgaattatgctcattctgctcagtgtcaccagacagattccttacaaaaaagagcactatgactcagcctaccttgctcaagaacaataattgtatctattaacaccttcccatcttccaagaaggaagaaaatattacatggctagaactgtgggaccaggttcctgttggagattttaccaggcccacaacaacactatgcatgtattaataaaacctcaagtgaatattcacagagaaatattcggattttacttacatgtgcgttgcatctggcatgctggttaaggcaggaggacttaggggaatgggctgttccttatacaatgttccatcgtcctggaagaaggtgggtaatctgaatggacagccaggtgagccctgtagagcctgcttcctggccacaccaagccaacctgagagatgatgcaaaagtttcaacctctacaatactctggcaacctcagggaatttatggttattcaaagcatgcccagtaggttaggattgatccaaatgaatgagactatggaagcaggatgctagctggtgcctgccaaccatccatcaggatcaacactggctgtggcgggggctgagagcccatggaggccatggagactgaggaaagtctagaaaaatttacatgtggctgaagcccagctgcaaatatccacaattacctgaactcaggacgctgtgttctgaagttttgtgtgttttagtttcattgcccagcataaatttacctattagatgttatgaaacttaaactgtaatggagctgaatgtgctctgagagatttatctcacttctgctgttcaaatgacatctgctcactaaataagtctcgacctgaacatgtggctaattttctctaaaaatctgcattttccaaaaaagtttttaaaaactgaattaaatagcaaactagaggtaaaaatactaaagcttcgtgtgttttttaatgaaaacatatgaaatataaaaatttaaaaacagtaatttagtgttaatttacatatagtaaaatgcacaaatcttaagagtagagctccgtgactttttgtgttatgtatgactttttgcatagtggccacttcccagatgaacagatagaatatttccatattccagaaaactccttcatactctttcccagtgcctctccaccaccaggtaagaactgtaccgattctttcaccacacttcaatttgtgcctgtccttgaacttcatataaatggaattgtacttatcaatttcctggcagcttttgctcaatgtaatgttttggagattaatccatgttgctgaagatatcagtagttaatttctttctattgctgagtagcaatccattgtatgaatatagctgaatttgtttatccatttacctgttgatggacatttgttttctttccagtgtttgattattaagaataaaactgaggctgggcacagtggctcatgcctgtaatcccaatactttgggaggcagaggcaagaggatcactggaggccaggagtttgacacaagcctgggcaacatagcaagacttcgtctctacaaaatattttaaaaatcagccaggtgcactgatgtgcacctatagtcctgcttacctgggaggctgaggcaggaggatcacatgagcccaggagttcaaggttacagtaaaccatggtcatatcactgcactccagcctggctgacagagcaagaccctgtctctaaaaaaaaattttttaggccaggcgcagtggctcacgcctgtaatcccagcactttgggaggccaagacaggtggatcacgaggtcaggagtttgagaccaggttggctgccacagcgaaaccctgtctctactaaaaatacaaaaaattagctgggcatggtggcgggcacctgtaatcccagctactcaggaggctgaggcaggagaatcacttgaacctggaaggctgaggttgcagtgagctgagattgcaccactgcactccagcctgtgcgacagagcaagactccatttcaaaaacaaaacaaaacaaagaccagcttggccaatatggcaaaaccctgcctctaccaaaaatacaaaaaattagctgggcgtggtggtgtgtacctgtagtctcagctactcaggaggctgaggtgggaggatggcctgaacctgggaggtggaggttgcagtgagccaagatcctgccactgcactccagcctgcatgatagagccagactttgtctcaaaaaacacttaaaaaaaaaaacaaacaaactggatatgagtttttttgttcatacttgttacagaagtctttttgttttaaaatacactggtatatacctaggagtagaactttattagaaactgccaagcggcatacagtaagtttagaaataactatagacatgtgaaataaaagaacttttaaaaattttgcttaattattgataaaatattttttaaaaattggtaaaataggaagaatcatctaacattcaaaatgctttataaagtaattttatcctatataaaatgctacaaatgttctctgatgatatacattttcaatggttgggactttaagcaagttgactttaggcaaataggtcttaggcaaattggcccaaaagctcaatatagattcttgtcaagacaggtctcccccattctgtactggtgtaattgaatttttaaacaatgcagacttgacattcatccctgtaggtttcataccagtaggaagtacatgtatatttatgcacagggatatatgggattaggatgctggaacaagtagacacttggtggaaggagggaaaggaattcctggccctgctcacagagctctggggagactgataatgggccatgagttggcaggatgcccagggagttaaaaccttgctgagccagggcaggggcctaagcaggggaaggtcctgaaggggctcatttggctcagtggggcctgcctggcaatgttgggaccagtttgtggggaggagctgggggtgtcattacaattaatgaggagagtaaggcagaggttgtctctggggatagtggcatagagaactacgtaactgagagggtccacagtgtcagtgggctgtgcaagttagcatttgtctgagaggaaagaaaactgttctggaatcaaccctaaacagtttttgtcctggttgcagatgtttcaaactttcattttaaaaatatgtcagcacatgtgattgcaaattttattattattattattaagatggagtcttgctctgttgcccaggctggagtgcagtggtgcaatctgggctcactacaacctccacctcctgggttcaagcgaattctcctgtctcagcctcccgagtagctgggattacaggcatgcaccaccatgctcgaccaatttttatatttttagtagagacgaggtttcaccatgttggccaggctggtctcgaactcctaacttctcaggtgatccacccaactcggcctcccaaagtgctgggattacaggcatgagccgctgcgcccagctgagattgcaaattttaaaaaatttatagtcatccaaatgtgttcactatcttttcttcatgtcttccacacttttgataaaattggcttctatgtcatctcctgagttattaataaaaaatattaaactgggcaaagccagaataaagcccactggaatgccaccagagactcccctccagggtgccggcaattcattaatcaacactctctacgaatgactattcagccaactataaattcacctcatagtccccattgacgtgtttccacctttgcacaagagactcatgagagatttaggagaagccatcacagaaatcaaggcacagagtctatgaaataccccaatccactaatttaatcacttacaaagaaagaaagaaaaagaaatgaggttaggcttgttcttagtgagtccacgctagtttctggcaaacattactttctttttcaagtactcagaaaccatctgtttaataatcccttctagatttttgttggcactgggggtgctcatcaatcaaattgtaaatttcatttatcaccccatttaaaaatcaggacactattttccattttcactgttttggctactctctctgattttccaggttctatcaaagatgttacaggtaacccttgccatcatctgggaggtcatctgtctgcaccagctggcttaaactcactgaagcaagctagctagtgtcatgggataaatgtgatcctcagatataagcagaaagcaactttattttgtctcccattgtcccttaaaatttattcagtaaggtatatcctttccctgtctatggatgaaaatttatcagtcctgtgacttatctgatcatatcactcatgataaataaaagtactataatcaccttaagtcactaaatatagtcttaatttagatattagaaatctacttttatataacaagcaaaactatacagtttgtttaaagtgaaatcttcctcttcagtttgagtctgcctcaggcaggaagcttacagctggtaacggtgtgcatttggtttcttctttttttttaacctctcctacatcagcttataaacctggaattctgactcctctagggtggggcggtactaagaggctgaggagtaggaaagctcttctttggtacttttgtaaaatggctcttcactctctgagcctagtaagtgtttcaagcattcttaatcttttgattttttcaggcaagaatcagacgccaatttactgcatcctgccctctccccattccccatacctgcaatcctttgaaacctctctccctcttaacttgagatgaaggggaaataccccacaccacgcaaactattctctccaaataactcttcctctcaaatcctatcccttctgcaccccctgacccttaaaccccttgtggttttaaggggttcacgagaaattcaacccattcaaagacacttaatgaaatatttgaacagtggcctcttcatattttctcttcatattacagccaaaagggagacagtcctatttgtatatttggttaaagtatttttccactatctgctctcttatcttggccttccttttccttcattcttatttgatggcatttcttcttgatagggagacagatgaaaatagttcagaatgtttatattctctctaaaacctcctttcattacataccatcttcctcaagtgcaggggttttcctcatttttgaaacatgcttttaaaaaccacaactgtcaggccattttattaatttataatgaataatatgaaggtcataaacatatattcatgtattatttcctaatggtaaacttaaaataggagtgggcaaaggaaatgcagtacccgatacagagactattactcaacctttagaaaaagaaaattctataatatgtgacaatgtggtaaaatggcaaatatattcaattatctttataaaaaccagaatggacaactttacaccaaacaaacaagtaagtctcctctctgatgggaaatacaaagaagaaaataaaaattatcagccataaacacctaaattattaataaatttctttttaatattttacttaggattctccatgtaataattttaccaaattgaaatactatttacccaattctgaatcctaattcttaaacttgctatactgtgaatatttcctattaccagtaaaattcttggaaacccatttttaatggcttcaaactaggccaatgtatggggacaccatgatttattaacctctttcccttgttactgaacattaaatttgtttccatttttttttaccattttgaataacaccacaacataaactattgtgcatatatgtgtgcttgaatttctgacaattattagaaggggagttactggatcaaaggtatggactttttttttaattttatttttattttttatttattattattatactttaagttttagggtacatgttcacaatgtgcaggttagttacatatgtatacatgtgccatgctggtgcactgcacccactaactcgtcatttagcattaggtatatctcccaatgctatccctcccccctccccccaacccacaacagtccccagagtgtgatgttccccttcctgtgtccacgtgttctcattgttcaattcccacctgtgagtgagaatatgcggtgtttggttttttgttcttgcaatagtttactgagaatgatgatttccaatttcatccatgtccctacaaaggacatgaactcatcattttttatggctgcatagtattccatggcgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaaaggtatggactttttaaagctcttaatacaagctgtcactttgctttctagaaagaattgtaacagattggcttatcttaacggacattgtcgtcaaactcaatcagtccaaggctccatctccacaccagagccagccaagagaaccagaacaatgtcagagacacaggacaaaagtggtttttggctatagtaaccatattctccaatctgggcatctgtttcaagggagtgaaaggagaaagtccatttgtctatttgcacatgtgtagtcagggttctcctggaaggtggtagcctcctccgatccagcctgtatctggttcattgccctataacacagccctatgttaatcataaagccaaagggcagggcagctttgttttctctcagccacaccccagtcaccttcctgcacttaaatctagggggctcctccaagaatctgtagccacaagttgataaacacattttcagatgggtttgttttgcatctattacaggttgaagtgtcctagttttgctctcaagtgatgacattcatccagagcatgttccaaatctgcccatttcccaccccatctgggttctgccttaccatatttttaagacagaaacacaacgtacagcaatactaagccatattctaatgacaatagttagataactttttttctgatttcaaaagtggtacatgtttaaagtggaaaatgtagacaacttaggaaaccaggaaaggaaggctgcagagtgaccagcacttatggcagcctgcctggcagatggagagtgcacgtctcggtggacatctgtgtggggtcagcagggatcatgttcagctcagcagatgtcaggagacatacagcaaagtctgagggctggtaagaactctcccgcttgacactacataagccctgagaacttggttccaactccagggaaaagggtggggggaacccataaaactgaaataaaaatcataacacagtagaatgacacttgatatagaaatcaatttcattggtaggaagacaaagaacagtggagtctagtttgtattctctttccagctcctttggcctctgattcccaacctctggtgcaccccaccaccagccttttccagtggctcagtttggttcagtcgtggtacctggtttgagggatggactacattctttaggcaccccgtgggagctagccctacaaatcaccatggaaactgaagatagagtgattgtccatgctggtcttagaggcaggtggttcccaggtgaaggctgggaaaagtcactcctacaatgatgtaataactctaccaatggccctcggtttctgaagatttgcttcccttaattctcctcactggaattgggggattagatctctgaaagcagagatgatataaaaacatatataacatatataaaaacaaacaagcaaacaaatagcccaatagggccatgagtcttggtagggatgtaccagtaagaaagagttctggtttccctaagccatggtgccagtcctggctctttgtttcaaaaggatcttcagagccacctggcacagagggctttctcttggagtcgttccttttgcacctctgcatccttggcaacatttcaggggagctcccgggtagggcaacatcttaactgtcaagacagtgcagcatcagagagtcacagaggcaggctctggaatccctagagaccaaggccaagaccaagaacaggacatatgtaccaggattggcattgcagtgatggctatagtcacaaacaatttgaaacatccaagctgttgagccataggggaccacttaaacagatgctggtatattcataccaaggaacactatgcactcattagaaaaaaaatagatttctgtaaataaaagggaatatgaatatgttcataatatattttaagtaaaaaaggcttaaaatagcatgtagcacatgatcttattttaaataaatatatatttatttttacgtattatatataggaaatctctagtgggataacagcaatcttcatttttttgtatttctctacatgtttcaaatgattttgacatgtttctctacatatgtttctctacatcatatttcaaatgatctttgacacaatgacttattgctttgtgtattagggttctctagagggacagaactaatagaagatataaatatatatatataaatgtatatataaataaatatatatatgtaaagggagtttattaagtattaacttacaaaattacaaggtcccacaataggccgtctgcaagctgaggaacaaggagagccagtccgagtcccaaaactgaagaacttagaatccgatgttcgaggacaggaagcatccagcacaggagaaagatgtaggctgggagactaggccagtctctctttttcacgtttttctgcctgctttatattcactggcagctgattagatggtgcccaccagactaagggtggatctgctttccccagcccacagactcaaatgttaatctcttttggcaacaccctcacagatacacccgggatgaatactttttatccttcaatctaatcaagttgacactcagtattaaccatcacactttgatttttaaaaagtataatctttgttggccaggtgcggtggctcatgcctgtaattccagcactttcggaggccgaggcaagtggatcacctgaggtcaggagttcgagaccagcctggccaacatggtgaaaccccctctctactaacaatacaaaaaattagtcaggcctggtggtgcgtgcctgtaatcccagctactagggaggctgaagcaggagaatcgcttgaacccaggaggcagaggctgcagtgagtcgagatcaggccactgtactccagcttgggcaacagagcaagactccgtctcaaaaaaaaaattataatctttgtcaatggaaatgtggctaaaacctgttgtggcagtcatggaggcatgccacttggatctccccttcaagaaggaacttgacatcagctatgggagttgggttagctgacagcctctagctgcagtgccttggggacccactgtaagctcaggcttttcctggacagcccccagccaatagctgagcatggagaggcactacttcccaccttctgccccacttggaggtcttcttgggcactctttgtcctggagctccccactggactgccagagactttctcaaagctgccctgtggtctgaagctcttcccatccaacgcttccttctgccttctccttccacagaggtcagacctgcatggcaatctgaggtctttcctgcctgttactgttccctctcaccctttattctttataggtaacactccgttaaatcttttgtacagccatgtgccacataacgatgtttcagtcaaggatcgaccatgtttccgacatggtcccataagattacaatgaagctgaaaaactcctatcacctagtgacatcatagccgtggtaacattgtatgcaactacttaatgtttaaataaatttaatgtagcctaagagtagtttttagagagtctatagtagtgtacagtaatgccctaggccttaacattcactcatcactcactcactgactcacccagagcaacttctagtcctgcgagctgcattcattataagtaccctagacaggtgtgccatatatatacacatacacatatatatatacacacatatatacaaaaattagctgggcatggtggtgcatgcctgtagtcccacctacttgggagactgaggcaggagaatcacttgaacccgggaggcagagttgcagtgagctgagattgcgccactgcactccagcctgggtgacagagcaagactctgcctcaaaaatatatatatatatatatatttgtatatatgtattatatatatatacacacacacacatacacacatatataaacacacacatatatacacatatatatatacacatacatatatatacacacatacatatgtcacccacgctggagtgcagtggcgcaatctcagctcactgcaactctgcctcccaggttcaagcgattctcctgcctcagtctcctgagtaggtgggactacaggcatgcaccaccatgccaggctaatttttgtatttttggtagggacggggtttctccatattggcgaggctggtctcaaactcctgacctcaagtgatccaccccgctcggcctcccaaagtgctgggattacaggcatgagccaccgtgcccagcctcatttttatattttatactatatttttactgtaccttttctatgtttagacacacaaatgcttaacattgtgttacggttgcctatcacattcagtacagtaacatgctgcacaggttcgtagcctgggagcaattggctgtacgtacagcctaggtgtgtagtaggttagaccatcattcatgtaagtgcactctatggcgggtccgaaaagaagtggagcctagagaagcatttctcaaaacatatctcttttgttaagtggcagcacaggatggcactactaactctatcttgatgtttgccttctggaggacctaacgagattcctctgtgttcctgaacatactgtgagaagcctggacttactcgttacacattctttccatagaaatacccctctccaggaattattattccagatgacccccaagtggtctaacaaacaaaatgaaatgtcttctcctgccaagattttcctcttctaattgtggctgcctgaaatttccttcattaagtctgcctgtcaacacctcccaatcccttctcatctctgccctgctacccacactcctgcgcaggttcagaaaaggccatcagtggccttcttggctacttctctaacccatacagagaatttgtgaattactcagtatttttaaggcactgcttttctgtttaaaccagccagagttggtttctgctgcttcctaagaaggctggctgatatgtatatctaatgcatagtatttttgcatatgatacattggcatggagaaaatcatatcatattcaaattcagtttaacaactaggttgttaacacaggttgcctgggagggtggtgaggtgaagatggggaggagaggaagagaaaggaggcgagcaaaaatagaaaagggaggaaaataagactgtattaaggagaaggcagcatgcattatgatatgatctcatgtttgcattcacatagtcagtatattcatataccagccatacctcagagccactgaaaaataaatttcccagggtcacacccagtcctgagtatttttcagagcttctcaggagacactgaggagaaaacagggttgacatttaccgaagtgatcctggaccatctgcatcagtattggctggacctctgtttaaaaattcatgttcctggacgccactgcagacctcctgagttaagaatctggagtaggatattctctgccctgggagagggagctcaatgccctgtggccacaggaccaaattcctggggcctagagcaaccacagaactctttggcagtaggccagttctggtgcagtgggcctcaccttttcaaagatctgcttttaaaattgttaatgactgttttacccagcagttccacttcttggaacacatcctaaggaaataaccacatgatgtgaaaagatgtatgaggaagaatgctcatcacaacccttgtttatattaatgaacgtttggaagcaacccaaatagcaatcaatagtggagtcgttcaaataattatgacacatccacacaatggaagggtatatagccattatgattatgaggtagagctctatgtacacaaataaaaatacattcacagtatattaagtggggaatgagcagggatctcgaatgcaacagatggcattcagatgcatggcatggctacgtcacgcaccatcttggggtcactttcttttttatacaagaaaacagacctgaaggctattatggagaactttgaatccactctattttattttatatatatatataaaataaatatatatacacacatatataaatatatatatatacatatacacacacatacatatttatcttttactatggaaaatttcaaacataaacaaaagtagagtgaatagtgtaaggatcccagtgtgtgacttcaacagttttcaatagaaggccaatcggtaccccaagtactattctttacccgaattgtttgcaagctgatattttcctaaatatttttttagtttatttgaatctggattcaaataagattcatacaaaatgatgaattgatatgtctcctaagtttctttaatctgcatgttctcactacatatttttgtttttcttttatagttttttggttgaagaaagcaagcttatcctgtaacggcacactatccaatacaatagccactaaccacatttgactagtgagcatttgaaaagtggctagtgtgactgaaggactacattttaaattgtatttaattttaattaatatacatttaaatttaaaagtgataacttgatccagttattggaaaactgaagtttgaaacaacttgggtatgtgaatctgctttctcaaccataaattttatgaaatctaaatacagtttaagtatttctgatgaaaatttagtgttcaaactgagatgtgctttaagtgtgaaatacacactgattttgaggatttagtatggaaaaagaatgtaaaatatctcattaataatttttatattgattacatgttgaagggagaatattttggatgtgatgggtcaaataaaagttattattaaaaacaattttgtctgtttctttttatttttttaaaggcgattaccagaaaattacaaattggttacatacaaaatcaagaagggctggagagttaacacttacccccgataggcctcaataagcacctgtcaagagtcagtgtgtaactaccccacttcctcacctcttgagtgggataactctgaagaatgtaccttacactatttcccagaattcccccacaggattaagctccaggcaccactgtggtacctagcttgataatacaccttttataggctgccttcccttctctctctcttccctgttcccctaccagtggttcttgcatttcccagataaactctttacattcaaatacttgtcttggggtcagtttctggaggaacacaatgctaaaatggtcccatattggccagtgtgagccttcaagccagctcaggagtctttttgatatgatcgtaatagtctgtgattgcttccttgcttctggtagtttgaaaagatatttcaggctcactctgtacatatctgttccagacttggagccttaaagaaaccctgactctttttaatgggaaatggtatttagagacacaatttgggactagaagtggttatttctatggggtttatcattgtttcaaggtgttttacgttgacagaatatatataaaatacgttatgaatttatgatggtaattccaattcaaagtcaaaactatagctttcttacttaactccaacaaaatgttacatctgtatctcttttgatcttgttgaaaatctcagttctcattgatactgacttaactacccatttgacttatcccttaatacacaagccacagtctgtgtttgacagaatgaaaacatcactactaaccacaatatcattactagaaacaggttaggtatttttttctattctttttgtccttaggatatatcccattaaggatgtgtaaggatacatagattgctgtattagaatgtcagttactggtttttaaagtcacttggaaaaattcgtttctgtcaggttagccacaaactggatatgctgtgagagttccttgtttcatttagttttcagttttagtaacagcattaacccaattaatttgttttataattatataaattatttattggttccaaagtataatctataaaacaagatatatttcaagaagtctagctcttgtcctgttttctctgccctattccttttcttctcccataagaattctaaagatttttaaatcattctattgtttttaatacatataaatgcatatgcatataatatatacaaatatatttaatatatatgtagctctcttttcttagataaatggtagaatattttacatctttttagctgtattttcttttctcagtaaacacaatattctcaagatcactaaacaatggtatgtggagaaatttctcattccttgtttctttttcaattacatggaacctcattgtatgattgtatcatagtgtattcaactagtcccttattggtgaacttttggattgtttctggtcttttactattacaaatagtgctataattaatagcattgtgcttgcatcttttcatatttctgccagtgtatctttaagatttattcctacaagtttaatttctgggtcaaagggtaactacatatgtaatttggttagacattaccaaattccctttcatagtggttataaaaatttgcattcctaccagcgatgaatgagaacatgtttttccacatacttatctgtgatggttaattttacgtgtcaatttgactgggtcataggaatgcccagatatttgcttaaacttttttctgggtatgtctttgagggtgtttctggatgagattaacatttgagagcactgaatcctaaccactagaccacgagggagacgagggagagattaatatttgagtcagtagtttgagtaaagaattcactgaagtaattgcgttcactgaaggcctgaatagaacaaaaaggctcaataagataattctctccctctgcctttcttcaagatgggatattggtcttctcctgccttcagtctcagactcaaactcaggctggaccttataccactgatttttcagattctcaggcccttggacttggactagaagtataccattggctctcctgggtctccagcttgccccctgcagatcttgggggacttttagcctccatgatcatgtaaaccaattccttataaatctattttctctttctctatatatatgttcaattggttctgtttctctggagtaccctgacaaaatccaacatgaatttttgccaatcccatgtgtgaaatgttatctcagagtgttttaatttgcatttctcttatgagagaggttgaacatcttttcatatggttaagagccatttgcatttatttttctgatggattgtccttatctctagcctatttttctacaagttttttcttttgtctatttttagaaattctttacatatttgtaatgttaaataaaagatgcacatttttttctggttgtctttttactttgcttgtggcactctttttggtcataaaaaatttgatgtaataaaatttatctttttccttatgatttctagattttgaatcataattaggacatattttccaactattgagctataaagactaatttgtattagttcatttaaaaatatttaaatctctgacccatttggaaaatatcctggtgtatgatataacaaatgaaactaatgttatcttttcatgtagctatctagatatcccaatgtaaattagaaatgccatctttttgccactaatttgagatgctgcctttttcatactctaaatttccatttgcaattgaaccaacttctgtatttctattctgttccattgtttattttattatacatgtgtgtagaaaaacacaaactcaaagtgctttttcttgtctctcactcaacaacaatcaacacagagaccgctataaccagctgtgtgtagggtatttccttgctggccaagcaagcaatcgattctgcagcaaatatcagctggatgtcctctaattcagttcaattttgacattatgtacctggagatagtatcagatcccacaggttgagggttcagtctccaaaattggcccccaccttcagatgccaaaaacaacaagatccatgttgtttttacctgtgcttcttattgactggctacaaatttggtcccataccacaactccctccttgagttcaattaatgtgctagagcagctcacagaactcagggaaaaacttaatatctaccagtgtattataaaggataccagtgtcatgaaggatacagatgaagagatgcatagggcaaggcatgtgagaaggggcgcggagcttccatgctctccctgggtgcaccaccctccaggaacctccacgtgttcacctatggaagctctctaaaaccatccttttcagtttttatggaggcttcattacagaggcatgattgattaaaccattggccattggtgatcaacttaaccttcagcccctctcccctcccaggaggtcgtggggtggggcagcaagtcccaactctctaatcgtgccttggtctttctggtcatcaccccttgttctgaagcaacttaggggctgccagccaccagtcaatcattattagcatacaaaaagacatcacttgggagatttcaaggattttaggagttgtgtgcctggaaacgggtcaaaaaccaaatacatatctcacattatcacatatgttaacatcatgctgttttaattaaatatattttaacatttgctagggccaataaccctcattgtgtcttctgtttaagtgttttcttagctcaagaagcttttcttcttcacaatgaaacttactatcaatttatgtagctccagaagaaagcctgctggtattttaggagtattacattaaatttataaattaccttgggaaaaattgccatctttattatattcttcttacccaaggacatgatctgttttacctttcttttttttttaaggtccacttggagtctttcaggaatattgtttttctcatgtagattttggatatttattaagtttatgcctaggtattttattttctttgtggtatcatagatggaatagtctctccattaactttttaaactggtttggtttgtgtatatgaatgctatagatttttatatgttgattttataatttgctgttttacaaaattttcttctcatctgtagcaccttttccatttgggttttggaaatctgtgatattgtctgcaaatagaaataatttatagtttttgcagtgaaatccataaatgacattagtatatggttttttggtttaatctcagtgaggttttgagattaatgttatacctggttcacaaattgaagttggaatttgtcattttatattatattggattgcctaactttaaacaatggattatctaatttaaaaatatttgatagaattcccaagtgaaatcatttggacctgatggtttttatggtgtttttatgtaatctttttactttaaattttccaaacactggtttattagaattgtctgtatagggatcaatcctgataactttttctagaaatatgtcatttcatctaggttttcaaagttattttcatagaattagggcaaagtaacttctcatgatttttaaattttccttttgtaactgagtaccctatttttaaagttttttttgtgtgtgttcactttatcactaggcaccccctcacattgctagtgcatctaattctatgtttttttacgcaaaagtgctttttcttgtctctcactcaacatctcacttttacacaaaagttccagagactaaatcttgaaacaattcaggcacctgtggaaatctccctgaccaggagattgcttcaaggatacagttaatttacaacccaaccaagcctgagataatgccaccccattcaccagaggggtcaataactcaagacgagtcatcggaacaagtcacgtagacctgcactgcgtcgccccctgtgtgtcctccatgccaaggcttccccttctttagcccttgcattttgcttggaaatttgaaatggttccattaaggcaagagcctggactgttttccccactgctagctttggtttataataaagtcactctccttctaccatatctcaatcttgctaattggttttgcaaccggctgaacctgcattcggtaacacactgttttatatttatttttgtacatttgtgctttctttttttacttaattaagttagcaaattgctatatgttgttgatttttttaagaagttgacttggattaaaaaacttatttgtactgcctttctgttttctaactcattaacatttaaaaatgtttattaatttatctcttaaatttcttccctgtgttttctttttattattttttatctttttgagttaggtatttttatttttttaaattataatttttattgcaattctcttcttctagctattttatttaatgctatacattttctaccaataactgcattagctatatctcataaattctgatatgttttcaccataatagttattaagacattttgaaatttcattttatacttcctctttgaatgaagagttcttttataaaatataaaaatttccagaaagaagggcttttttgcttttcctagtattactttctagttttattgcattatggataaagaatttgctttatatttgctatgtcctttgaaatgtactggtcaatgttcatgaatgctctatgttggcatttaaaaaggtgtaggctggatgtgagatggctcatgcctatagtgtcagcactttgggaggctaaggcaggagggttacttgaggcctggagttgagaccagcataggcaacatagtgagactgtgtctgaaaaaaaataaaaaattagccaggtgtctttgtatgcatttatagtcccagatacttgggaggctgaggtgggaggatcacctgagcacagaaggttgaggctgtagtaacccatgatggcaccattgcactccagcctgggtgacagagtgaaacactgttcttaaaaaataaataaataaaaagaaaaagaaggtgtattctctagcgtcagggtcgagttggatgtatatctaagttttgctgcttaatcttggattgagcgaaatgtgttaagttcttctgttcttagtacacatatgtctagttcttcttgcatgtcctctaaattttacataagttgatgctgtgtcttgggtgcataaatattaataactaatatttcttcattgcaaattgtattctttagcacttgtgtccttctttgtctcttctaatgattttggtctgaattttatcttgtcctttatttagattctgacctctttttttaaaaaatttgcatttgctggatatatatttgtctaaatggttattttaacatttataaatctgttattccttctgtacgatatggtaatgaattttgcttggctagctgaaaatcattttgttttaagttaagaccatttgagtacactgacattattgataggttgacctcaaaaattttgtcatcttgttttatattggaagtatatcttatagaaataatatttgcctttatggcttattttatttcatcctttttttttttatcagggagggtatatcttttgaatgtaggcaaatttatattttggttctgattgttacctttataccaattctaaaacttttactcctaatctcctgtttttcatgctcttgtctactgatccccctttccccatgagtgatattgaagtttacctagtaacttcttctttctccatgtcttctccaaatctaatttgcaataatatccttatactccccgttaaaacctacaaggaagattttcttttttaaaattgatatatgtaattatatatattttggggatatatgtgatactttgatacatgtatgcaatgtgtaatgatcaaatcaggacaattagggtattcatcacctcaaacatttgtcttttctttttgtgttgaggacattgcaattcttttcttctggctattttcaaatatatgataaattgttattaactataatttctctgctgtactctccaaggcagttttcaagcttattgaacttcttatgtactttctccattcttatcccatttttgataattgtgctctatttatattgtcaggacataaagccgttcgtactattctttcttgctaagaaccatcatttagtcttaattctacaggaaaccatgtctttcatgcttatcagcagtctttgtgctgatacttctccagtcattttggtcttttgaagtacattctctagtggattcctcaggaaggattcataagaacaacattgcctgagttttttgcattttcataatagtgtgtctgcctttatatttgaagatcagtttgtttgctataaaatccttgcttcatagtttatttccttgagtattttaaagatgttgcttcatggtcctctagcaaaaagggttgtgtccaaaatctaatggcaatctaattttctttctcttataaatgacttggtctttttgccaatgtcttttaagatttttttttcttttactttgaagtcagtagtttcactagaatattggctgttttaggttgattttcccagatataaaatatacctttcactataaagtttcaagtctgttttatttcaggaaagttttcttactttaaatatgtttgtatttgttttattctattggtttgattttcatcttcaggatttttattccacacatattgggtcttcttcatttgtctttgattttaacacttttcttcttacaggtggtgttcattcatatttgggttctatggtcgtctgaaatatggctagaaagaggcatgaggaaacattttaaggtgacaaaattgttctataccttggctgctagtagctacaaacttgtatataactaccaaaagtgatcaaactacacaattataatggatttgttttattgtatgcaaattatactttaataaaactgagaaaaatagacaaaaattctttgacactcctccaccaagaagtggagtctatgtttcctccctttaaatctggatgggtctgtgactgcttcgactaatagactacagtgcaaatgatgctatgagacttccaaggctaggtcatgagggactaaattggtctgccttggtatttggaacacttactcttagaaacttgggtcaccatgtataaagcccaactacctcaagaacatcatgctggaggggtcacctgtcggcactccaatggccagtcctagctgaacctctgctccagccatcctagcccaagtgccagataggtaattaaagaagccatcttggaagtagatctaaatctaatcccagctgtcttagcccctggccattcaagttgtcccaattaagcctagaatccatgagcatgatacaattgttgttggtccattccactaaattctgtggtaataaattatgtagcagtagaaaattagaacatgtcccttccattttagtcttcatttgtgaaactgttttttatttctttttctttcctgagttgtcatttctcttttcaaatcttccttttctcaaattacttcctttctaaatttttctaatctgattacactattatttcatacacttatcatttttctttattttagttcatttaatatattaggttacaagttttacctgttttataagcacgtctttctaacatgacttcattatctgtcatgacattctatcccttattttcctttctcttatagtgactttatatggaacttgctcacgatcattttctgttgctcatctctttcatttttaggtattttgtttctgtttcatttttaaaatttgtatatgtttagggtatacaagtgcagatttcttacctgcatcttttgtacagtggtgaagtctgggcttttagtgtgcccatcacccaaatagtgaacactgtatccaataggtaacttttcaacactcacacccctcccaccctcccaccttttgtagtctccagtgtctgttactttactctgtatgcccatgtgtatccattgtttagctttcactttataagtgagaacatgtggtatttgactttctgtttctgagttatttctttaattaattcacttatttattttaagttccagggtacatgtgcaggatgtgcaggtttgttacataggtaaccgtatgccatggcgatttgctgcacctgtcaacccatcacctagatattaagccctgcatctgagttatttcacttaggataatggcctccagttccactcatgttgctacaaaagacataattttattcttttttatggctgagtagtatgccatggaatgaatacacacatacacacacacacacagacacacacacacacaaaccacattttctttatccagtcttctgttgattgacacttaggttgattatctttgctattgtgaatagtgctgcaataaacatgagtgcaggtatcttttttcatataatgatttattttcctttgagtagatacccagtagtgggattgccagagcaaatggtagatttattttagttctttcagaaatctgcatagttttccattaaggtttttactaatttacattcccaccaacagtgtataagtgttccctttctctgcatcctcaccaacatctgttgtattttaactttttaataatagccattctgactggtataagatggtatctcattgcggttttgatttttacctctatgatgattagtgatgttcagcattttttcatatgtttcctggctgcttggatgtcttcttttgaaaaatgttcctgccctttgcccactttttaatggggttgttttttcttgttgaattgtttgagtttgttgtagattctggattagccctttgctgcatgcatagtttgcaaatattttttcccattctgtaggttgtcttgtttactgtattgattgtttcttttgcagtgcaaaagctttttagtttgattaagtcccatttgtctatttctgttattgttgcatttgcttttgagggcttggtcctaaattctttgcctagcccaatgtccacaagggttttttctgggttttcttctaggattcctatagtttctggtcttacatttaggcctttagtacatcttgagctaattattgtatatggtgagaggtatgggtctagtgtcattcttctgcatatgggatatctacttttcccagcaccatttcttgaacagggtgtcatttccccagtatacattgacttgttgaggatcagttggttgtaggtatgtggctttatttctaggttatattctgttccattgatccatgtctctatttttataccagtaccatgctgttttagtcacaacagacttgtagtaaaacttgaagtgaggtaatgtgatacttccagctttgttcttttttcttaaaactgcttcagccattcaggctcctttttggttccatgtgaattcgaggactatcttttctaattccgtaaaaattgacattggtaatttgatagggattatgttgaatctgtagattgctttaagtagtatgattattttaacaatatcgattcttctaattcactaccgtgggatgtatttccacttgtttatatcatctctgatttctttcgtaagtgtttaatagttctctttatagagatctttcactttttttgttaaatatgttcctaggtacttactttatttgtagttattgtaaatgggattgccttcttttttcagtcatcagctagatagttattggtgtatacaaatgctattgatttccatatgttaattttgcattcttaaactcctgaattaattaatcaaatgtaagaatttttggtggcgtctttagggtgttccagatataagatcatatcataagcaaataggaataattttacttcctgttttcaaatttggataccttttatttctcttgcttgattgctctggtgaggacttctagtattatgttgaataagagcagtgaaagtgggcatccttgtctatttccaggtgttagaaggaatgcttttaacttttccctgttaagtatgatattagctgtgggtttgtcatgtatggccttatgtttaagcatacttattcctaagcatattattccttctaaggaatagaacatattccttctatgcctagtttgttgaggacttttagcatgatgggatgctgaagtttatcaaagacttttctgtgtctattgagatgatcacatggttttgtccttaattctgtttatgtgaggtatcacatttattgatttgcatatgttgaaacatccttgcatccctgggatgaatctcacctgatcatggtgtattatctttttgatgtgctattggattcaatttgctagtattttgttgaggatttttgtgtctatgttcatcagggatatcagtctgtaattttcttttttcgttgtgtccttttctgattttggtatcagggtgatattggccttgtagaatgaattagggagaattccctcctcctcgattttatggaatagtttcagaaggatttgtattagttcttctttgtatgtttggtaggaatcagctgtgaatccatctaattatgggcttttttgggagggggagttttttttttttattactaatccaatctcaccactcattattggtctgttaagttctatttcttcctggttcaatctcaggaggttatatgtttccaggaatttatccatatcctccagattttcttctttgtgagtgtatagttgtttataacagtctcagatgattttttttttaattctgtggtatcagttgtaatgtctcctttttcatttctgtagtgtttacttggatcttctttgttcttggttagtctagctagtggtttatcaattttgttcatcttttcaaagaaccaatttttaattttgtttatcctccgtattttgctattttatttagttctgctctaatctttgttgtttcatttcttctgctacctttctttgttcttctttttctagttccttaagatataatattaggttattaatttgtgaccttttagttcttcgatgtaggcatttaatgctgtaaacctccctcctggcactgcttttgctgtatcccataggttttggtatgctgtgttttcactttcatttgtttctagatttttaaaaaaatttgtctcaattttctcatttttaatgagagaattttttggtactttcaggagaaaaaggtaggctggtataaccttcgtagatttactatcctggatgttcactttcacaaagtaattttcttttttttttttctttttttttgagatggagtctcactctgtcacccaggctggagtgcagtggtgccatctcaggtcactgcaacattcgcctcccaggttcaagcaattttcctgtctcagcctcctgagtagctgggactacaggagcacaccaccacgcttggctaatttttgtatttttaatggagacggggtttcactatattggtcaggctggcctcgaactcctgacctcaggtgatccacctgcctcggcctcccaaagtgctgggattacaggtgtgagccactgcacctggcccacaaagtgatttttttaaaaaatatggccaaatattttctaagctgagtccccattgctcttgtctctcacttttatctctctcctatttctcctcccccaaccccgtgatgcttcatttaaattctgttcccagtgagtacgtttcagtgcagtttatcctggaacaaaatttgatgcgttagtttaaaaaactcagagagcccagagtgttccaacactttccaccttccagagatcccttggcgctcacatgcaaattggatcctatgaaacttcctccaacttttggttgatgttctcagattgagccaccgagatttccaaggcaatttgtgggttggctttcaggaatactagagtccttttctcccccttctctcccaaacaatttccaaaatcacatggttcttgcagttgtcagtagcttatacccatctactaatattttggagttgttaccacaccttgtcacctacttatgttgtagatcagtggttctcagactttataatcagcatcacaagaattgcccacatgaaagcttgcacacaaatgtttagagaggcattattcataattgcaaaaagtggcaacaacccaaatgtccaagaatggatgaacggataaacaaaatgtagcatatacatacaatgggatattatgcagccttaaaaaggaatgaaattctgacccatgctataatatggatgaaccttgaaaacattatgctaagtgtaatgagctaaacacaaaagaacgactattatatgacccatttatatgaaaagtccagaatagacaaatctatagagatagaaagtagattagtgattacctagggctgcgggtgtggttgtggggggtagaatggggagtcattgctgttgggcatggggtttctttataggggtgatgaaaatgacctaaattgattgtggtgatggttgcacaactctgtggatatactaaataccattccattgtatagtatgtgaattacacacttcaatagagctgattttttaaaagcagctatattgtcacaactgccatcttcccagaatctccttattctaaaaaatattaattattcacaaatgttggtacttccattcattgtaacaagtcttgtataaaatgccttgcaaacaatcacacatggcagtctatcaagggcaccgtgattgaaagctggtggctaagtgcaccctgaggaaggctttgtggctcccgactgttgctcccagtacatgctgtggtgacatagagtaagatttgccatgataaagccatgctcttggcctcaggacaaagcctctcagccctgggaatctcggcccctccctggccctcagtgcagcccacacccagttgcctctgccatgaaaggaagcggacaccttcctccctggctattcttttcccactggcagactccctcccagccctggttccaagggctgtcagggtcaccctccctctcctcaaatcccccaccccctgccccatcaggactcattctgctttccatcttttcagacaataaagacactagaggaatttatttatacctccagccagctaataagacaattcaatgaaaagcagcccctgcttgctggagcatcctcgggcctttgattgcctcttctgtgtcccaattcccagcatttattctacatataaattttccacggtgaatagacaccattcttctcggaataccatttgttcccttggttattttatttccatctcgttttgctttttattattactgttaaactgtaattaattcttctcctatcagcttctctttagtgaactaagcctaatgcagcatgaagtgtcttcactcacccccaactatacacctattcttgaaaataacgaagcctctgacatttcaaaggcccacaagctgctaaatctttccttctatggaatgggagtggggagggatggagggagggagggaggaaagtctgggcaggcaaagtgatttcataaccaggtgactgtgggtttcaatttagctgagatagttctgatttcatttagcagacagacacttgaaaggttaagaaagtcatgaaggaagtgtgggagaaaagctcaaatgcactttaaaatgtggcccctgtcctgctgctcaaatttggaaccactgtctttcttcccatctaaaaggatatttgctgcattacattccctctaagttttcacagcatcccctcaaggtcagcctctttgaaaggtataccagcaccatggacaattctgtgatggcatctgtagtgggttgaatgggggtccctagatatgtccacatcctgatccctggaacctgcgaacgttaccctctttagaaaaagggtctttgcagatatgattaagtttagcatcttgagatgagaaggttctgcattacccaggtgagaactaagtccaatgacaagtatccttataacagacatagaagagagtgacagaagagtagcaggtgatgagaagacagagattggagtgatggggctacaagccaaggaacaccaaagattgctcagaaaccaccagaagctacaagaggccaggaatggactctctcctggagcctccagagggagcgtggccctgacgacaccttgatttcagatttcaggcctccagaactatgagagagtacatttttttaagccaccaagtttgtgatcgtttgttataagcagccacaggaagctaatactgcatccttagtttgccagctcatcatgagcagaaaacacaaaagagaaaagactggataataccaagtcacaaaactttaacatgccaagctgttgccttcagatggtagaagtctgggttgtcagatcagatgaggctgcccacataactcaagccgaaagcacgcattggatgcaggaaatgaattcctacaacccagaccttgccagaactggctggccacagctttgctttctgaaatatggcttttcttaaagaggatgtggcatacagttggctcagctgtgacttttattttacatttacaattcctttatccaaaagatttctaagctcaggtatctatatttcttttttcctcccaaattttctctatttctttttcttttaatagctagaagaacacgtttatgagtagttatagaaatgtcccagagtcatgggtctgcatgggatctgagacatcatgtgatttgtctcagaaagtggcatgccccagcaggccaagtcactagaggggttttccattcaaatgtttttaatattttactcctttgataattgataattcctttgataattgataattgatagttgataattccttattggctcccatttttctttctccatttgtcccagaaacttatgctcattctccctgtaaatgtgtccttatttcctttttcttctattgccaacctctgatataatatacaatatagttccttgtcatgtccctaggatttcacatgggctagtatggacccaagcttttcacctctcagtagaaataatgcctaatagtgcacacagtggagcctcataaacaatgtgttgtctaaaaggctgagtttccagatgtcctagccgtatagagtaccactctgttatactttgattttatcctgtgggaaaatatttgaaaacttacacttaaattgattctatctctattatttttaaataacattctcttgtagcttacagggtacatttctatcctaaatgacatgtttctgtttaacttgcgtgctatagttctgtgtgtgtttacatctgtttgtgcgagcatgcgcaagttcatgtgtgtttgcacgcaaaatccctctggtaacagaaagtttattttccctcttcccataactgaaagtccactgaatgaatttaacttaaattacctctcttggcctaaataaataaatacaatatcagcaagataaattatgacctaaaatgttatttcttatttttaaaaagtgaaaaggtgagggtaattgagtttgctgttcgaatcacagctctgactcttggcaacaccctaaaatatcatgttccacctcagttctgtaacccaaacacagcagcagtgaggccctgcttctgcactgatgaaaggttttcatttctggcagggcataccgtaaactgaggcccacagccacgaaacaagaggtggtgtggaatttacaaagctctgaggggcaatctccatccatttgtggtgattaatatctccttccttggcttgaatgccaaccttcaattagaaacggaaacagaaccttcccttttatagagcagacccccaagacagcccctggaaggggatttcccctggaaaggaaggcccggtaaaatccaaggagaagagctgaaattcccctccattagcagagggtgtctgcattcctggggtacttcctgcatcttccaggctgccctgctgggcaccttataccatggcagggagtgatgtcaaaaaggttatgttctcatgggaacttgaggaaggaaaaaggcttagtggatttctttagttattttggtgactgtttctatttttcaagaatgtctaagaatctaagggaaaatctcaaggttccccttcacccccagtctcttccttccattgaatttgggaactcacctattagggccaaccccatttggggttcttctgcttccagtcagggctgagactgatatcaccaatgccactgccagtcaggtggagaatgggattattgtgaatagcagatttcaaaatttgataaaatgtttatggttatgtgaagaataatgcaaattctgactcatcataatggcctatccttctcttcccagctctttcctccctttggttgtgtgtactgggagctctggcggatgagattgctctttaaaaagacccttgtgggtgggcctggtcaggatactcccagaactctctggtgaaggttgatttccacattcaggtatggagtgggcattaactgcttgcccctctactccacattcattccccaccaccttctcacccacagagtacacatcaggcactggggttgcaagagtgagtaagacaaccctccgccctcatggggattgtctcccggttaggaagacacactgaccacatcaatcaatcactttagatggttctaagtaacatgaaaaaaaaagttaatgtaatataggatagatagaagatgggtaactattttttagggtgattaggaaaggtctgagaaagtgatatttgggctgggatctccacgatgacacatatataacctcacggtaatgtacagccagtcttgagaggtcatcagtcaggcataaagcaagggagtggtcaggagtctgggtctgctgcctggaagccaaggagaagaggaagaccaagcagcatggttttcacccttcatccctcatacccccagacccctcagctgtcgtctgatgccactgacacgttgcaggttacccaacaccatgctctagaatgaggtctgagctgggcatcagggccctcaaccctgacatccagggggttccatcagctgtgtatgcttctctgggccccatcccctgcaaccctcacagaaagagccgcactgctgaccgtgcagggccgtggctctaagccacgcttccctaccctcttattacagtccagcaaggaaggaaggcaagacctggccaaatgacagtcataatgcagtgtgatgagctcggggacagatgaaataagggcccagcagaaacccaagcccagaagggaggggtggcaaggctgtgcaggaggctgccaggggagctggctcagtcttgctcgctgccagcctacctcagacttgaccctttgtagcactttacagcaatcatcttggctctacttgacaattactgtggttcagcaataggttaggccaccgtgtgtgagtacacctgcaaatttggcctgttctgggtgcctccaccctcctggagctgcactctctgcagtaatcttgctgggtgtttcctaagcacaatggagacagctgggtaggcctccctgtgtctagaacaaacccaggcctctcagccaagtccagtcaccccctgggctcctgttcctcttccctacccactgtcctgccagctttcacaccagcagtaaacctagcccacagcattggagctcagcggaccctgagaaaacattcccaaagtagccattccatggctaggctgaaggacctgggatggcttagtcctgtaggctacaggaacacaaattgtccacttgaatatttgtgctgaccacggggcctgatcacaaagataaacttcatggccagggtggacagacccctctcaagagcagccatctcaggaagtttgaagctgcagacagggactgttagcatttgtccatactgggaaccaaggtctccagagcaagcaacaatgaaatccctaaatccaaagggctcatgggcttgttttaaggatcagtgaagaaggacgaagcaaagcattctgtacttcactccagagctaggccagagtgggtggtgggaggagtggaggaggcaaggcagaagtcctggaacctgtggaagaggaaggatgctggggccaagcatagaaagccagggtaggggaagtgggtcctgacacctgctcttacttgcctcactttagtcctagccactgactaagtggtgacatctatctgcacaatggttcaaggcattttttttttttgagacggagtctcgctctgttgcccaggctggagtgcagtggcgtaatctcagctcactgcaagctccgcctcctgggttcacgccattctccttcctcagcctcccaagtagctgggactacaggcgcccgccaccgcgcccggctagtttttgcatttttagtagagacggggtttcaccttgttagccaggatggtctcggtctcctgacctcgtgatccgcccacctcagcctcccaaagtgctgggattacaggcgtgagccaccgcgcccggcggttcaaggcatttaaggagcaccatttaaccattgcctatcagtgggcatgtcagtggcaccctaactgagtgttgctgtttccaaacaatgtggcatgaatgcatctaaagggcaggttatcaatggaaaagcagaccaccacctgggattcactggtataaaataaatgtctcatgcaaatcaaaatgatatgcatttccaaacgtatgtaaatgcataaaaaaggtcttgaaaggccacagcatggactgatgacaggggtcctctcttggggaggactagggttgtaataagtatggagaagcattggaggaaagtgtggtttgtctgtgtggtttcaattttttttttcagcaagtatgttttcaggtacgtcttaggtacattttaaaaacttccatacatctccctgttcttcatgttgctggaggtgcagcccaggatggctgagtggggtggatggctctgttggttaggacatttcataacaggctctttggttatgagatagtctaaatgaaagaggcttgaaaccaaagagggctagcttactctgaaaaggacaccagttttgtgctggcaaccaggcagagagagtctccaagaccctggaatggggaaagagtctagacaagagggagaacacgcccaaagaatggcagacgctggggccccaagggaaacgacggccactgagactttcctatgttgtgtggctcaagcctataatatccaggatggcagaaattctacagtgggttgtttcctgctcagaattgccctatagtccccttagtaatccctaaactcttagaaaaagtctgctgcatggaaaaccttatttgagtggagctttaggaaacaaaggagaatgtgaaatgattaagggcaggtgacaaaactcaaagggagcagaaattcgaggtgatgtaaccaaggcattgtgaaacccctgggggtccctcggaaatcctgggatgggcagtagcttttccgtggtacatgggatggaggcttcagcatgtataatcggccagttgaagagagggactccaaaagactgaagatcctgaggctatgtgagttaatgtaagtaaaaacatgccaattgatttaaaaaaaatcagaaacctataaagaagtaaaaagtgctagcatagcgtttccatccatttggtgtaatacattcactcattaaatactaaactcacgcactgccccctccaactttcccctctgcaattgcatcttatggtctagcttttaaagtaatgcagtacatggagtcagaagcccggagatccataaaccatccagacatctaatagtgctttaaaagaggccctgcacactggagggtaagtggccagtaatggctgagctgggtacagacagggtggggagagggcttggggcttaagggaaaagtgaagtagtgagcataaggagaatttttacagtggctataaaaagaagtcccatgctcgcacatttagattctgagttggccaaataaacccaggcctcttgcagttcacactgtcagccttggcactggttctggtggctactgtcttagagacccagtaaaaatgctttgagagagagaaagacatcaccatctcattgaggagccagtgcaaggatagctcccagaagggcctccctgttaccaggagttacaggcagcaggcagtcctcctgtcaataggctcctggcaggtgatgattactattctgcaccagcctctggttccttggaacataacaatgatgtaggcttctgagcgagggccatgctttgcagtcttggaagggaatgtctgtgtttgcaaaatgctatgacttagggttgctaaccctgtagcccattcccataggaactccagatggaaatgctcacccatcagcactccctaaactacctgctcccaaccagttgctggtgacaaatggaaatgtcctgccccagcactgctctggagaagtcaagacacacttaccagcttcactgcaactctcagtttagatgcaccagggaaggaaggccactccctggctgataaatgtttcactagctctctagggaataaaagccctggtttgcagcatttcctgattcccaggagtaaatactcccacaggctaccaagccatgtcgctgggcatggagttgggaagtagggttcaccatgcggtaatcaatggaaataacctcaagaacacagctaatagtaaaatgtagtcagagaattaggatgtgatgtatctgtgtatttattacctgtgtcttcaataagattttaagtgtatataatttaatttttaatcattgttctatttaataactggcttccattcctgaaaatttggcaactgacactcatgagctagtacatgagctggctccagcaaccactggctgggccctggggccttcttgctttgggttctggatctaatttctttttgtaaattttcttcgtgcttcttcctctcttctctcttccttctctctgggttttttgccccacctccccactttgcccaatttattgagcacttaagacccatactgagtaccttatgtgtaattggaggggcccttgttggggagacttccagtgcatgcccgtacccagttgtgctcttcttttggcatgaaaaggacaacgcttctttctctgtcttccagcagttaggcagagccatatgaccagctctggtcattgggttgtgaatggaagtagcatgagtccatactagactgaagcatttcattgatagtgtgagacttctcaatgctctcctttcctattgcaacaatttggagaaggccttgtgtatagatggcatgggcaaaagattgaggagctcaagtcactgggttaccacatgtggaggatggttgccttcaagagtcagctggatccgtggtgggttttgcatgagtaagaaataagtatttacatgtcaagccacagaattttgttgttgtttgttaatacagcataatctactctatccgaagtaataacttgccttgccgtgaatggccaaacatatgctgttattatcaggaaattctgtattcctcccgtaagcatcctctcccccatcaaaagctttatttgcctaggaatcaccatgtgctacaagtctttttggttagttttgcttagggagttggacattccagtcagcttgaatactatagtagttaggctatagacaaacaaaccaaaatacatggtgattataaaatgaaaatttcagacacttatttctcttaaacataaaagtttagatgttaacaatagttggcaaggtacatccctccatgtgtggcttccacctctgggtccaaggcgtaggacccatttgttactctttcctaaccagaaacgaaaagaaaaggggctgggaaaagggacccaattctttttagctaagaccccaaagtggaacacatcctacaacttctgctcacatctcgttggacaaaaacatagtcacaagaacatatctacctatgagaaaggctgggagatgtagtctccagctggactaatgtgccctgctaacagctggtggtgcatttctgttacagaaagtaagaaagagggaagggatacagggagaaaagacttggtctctgccatgatctattgtgttgtcctggcatgggaggggctctagctgcctggtgtggagaagctgcccggtgtggagaagctgcctggtgcagaggagctcttcccaagcagagtaactcatcctctctgatttcttccatggaatggctgcctgagtggcaggccctttgaagtcatcttaagccattttgtactgctataacagaatattacaaactgggaaatttataaacaatagaagtttatttgtctcacagttttggaggctggaaaggccaagatcaaggggctgtgtctggtaagggttttcttgctgcatcaccccatggcagaaagttgaaggacaagagagagcatttaagtgagagagcagaagagcaagggatctataataaagggattaaggccacaagttcaaaggcattaacccattaatgaagctggagccctcatgacctaaatactttccattaggccctacctgtcaacactgttgcattggggattaggtttctagcacatacttttgggggacacattcaaactgtaacaggggtgtaggtgatttcacttctctagtattatggctccaacccaaggaccccaaagtcctagtgctgcttgtttctttccccagctttggtttgggtgagaatctgctcccatgaggattcctgccatggaggggcacaggcagggggcaggaagcacttgtcagactgtctgcagggtgatggccaaggagtggtagggtgtgtgagctctggagtcagagtttcttgggcaaggtgcttaatcttttctacctcagctgtagaaaagagtaagcaccttctgttactgatgataataatgataccaagctcataggattgctgagattattaaaggagatattgatgtaaatgtgcttagcatagtgctttaataaccattagctattgctgctactactactactattactgctgctgctactactgcagttatctggttgctactaggggatagagtgaccagttctttcgcatatagttgcttgtgcaaggtggagctcttcactacaaagagtggttatagcaggctccaggatgccttgtgtcctaaacctagaactattctctcccatttctcccttaatactctgtactgagcagcctgctgttctgtttctgctctcaagatacctttgtttcaagattgttcacacccttctctgacactgggctttcacaggtaccagctccaggtctcagagaggagttgggctctcagtccattcttcccaggagggtctctgggtgctttctgcaaattgattttcccactgtctaaagttctggacgcctaagggattatctgtctttgccatattaaataaaagtcctattatacctttcctttttcccagaagtgggtagtctgtcggcctgacaatttatataacaaggatagcatgaggtggtccctgccccaacccagacagagatgccgttgtcagctattctaaaaccaataaaccaaccaacaaaatataacaatgacaagacaaaatttttgtacaaaagcctgttggaccacccattacaagatttatctcatgtgatcctcacagcaaacctctgagattggtatcatagagccaggtctatttaaatataaaatattgccttgctctggtcattaaattgctcacaccaacctatgtagacagaactaacacaagggaaggaagaaaactttacatacctaacagcttatctgtaaggttttgagaaacattcttatcatagataggactcttatagatgcaaaagacaaactcaaaatcaaatggattaaacaaaacctgcaattttttggctcaataacagtgaaatccaggagtacctggtttcatgtatgtcaggacccaggtgctcaggtgatgtcctcattgttctgccttttcttctttctgctctccctacggtggcttcattttcaagctcaccctctctccatggtggtccccgaaactccagtgccacaggctaccagttccaattcagaagaaagagggcttctctttccccatagcttcagagaaaatccaagggttgtgactccaacaaagattctctccttgaacaaactctatgcagactcccctgaactctcttctcaactgagctctgacatttgggcgtccgtgtttacctctgcagtgtccaattttggtaagaatcctgctaggccagttcccctaatctaatcatatctacagaggttcttcatactctaccatcttctcggtgatgtatgatcaccatggttgccttcagcatgaattctgtttggtcagtttagccaggattctctttacctctgatgtttctgctaagtagttttctatccactgatctccaccttgctccttggctatacattcccactcttccttgtattcagagttgagcccaatctctctccattgcaaaatcttattgcagtggtccttacacctatcataatggtcctgactaaagtctgccttaccatctttaacaagtgtcaaaaacaattgcttttcagaactcattggctcattgagccttgctgaatccatatgggccatgtacttaccccagaatctagggggaattgggagagagtgaatagaaatgggaaggatgcccctaataaaaggaaccagaaagtaaatcaaaatcagcagatgaatctggatgcacctatacaaaatgaaatgatgacaggacatattttgattccctgcaatataaaatgaatttatctcagttcctttaattcagggattcttgcttttggctgcatatcggtctttaaaatccggaggcttaggccacatcccagactcaggaaaccagaatctctgggaggagggtctaggcatcaaaattttaaaaaaatgaattttaggtgaggaggagcttcaagttggctgactagaggcacggaacaccccttcttctccacaaagaaccaacaaaataatgactagataataacactttgaacagaacaactgagaactctggaattcagcatcgaagtgacaggaaaaagctgaggtgcctaaggaaaaggaagtgaggcagacggcctggctgggatcagccaggagcctggagaaactctccagtctggaagaagagtacatgagagatctccagtggtccacattcctactgtggactcccgcagtcctagccataggagagtccttctacctgtgggccctgagactggtatagggagctccctggagtccacatgacaacattgctgcagataggaagtacgcactgggtcccacacgcctgtattcgtccgttttcacactactataaaaatactacccgagactgggtaatttataaagaaaagaggtttaattgactcatagttccacatgggtggggaagcctcaggaaacttacagtcatggcggaaggagaagcaggcactttcttcacaaggtggcaggagacagtgtgtgtatgtgagtacaggaaaaactaccatttataaaactatcagatcttataagaattcactatcataagaacagcatgggggtaaccacccccataatccaatcactcctttccttgatacatagggattacaggtctctccctcaacacatggggattacaattcaagttgagctttagatggggacacagagccaaaccatatcacccccctaagactcaagcagctgcagaacggtaccattttgagagctcagcccctaccagactgtatccccttccccagggcccaacagcctctgcctgtccatatccctggagacccactgacatctacctgcatccacccagagggccgcagtggtgtgatgcaggtggacccagtggaacagcagggttcccagcactctagcctactctgtcctgtgtgttggggaaagggcagagcagtgcactgaggaggctgtcccctagacaaaaggaggtgaagtgtgcatgccccagagcttgaaacctgtctgcctggggccaccgtcactgacagcaaccttaccccaccagcagcttaacaacagcacacttccatgtgccctgaggatagcctctctcagccagccaccacaggcagggacctgaacgtacacactccccagagcctgagagccacctgtctggggtagctaccacagacagcaactctgtctcccttccctagcagcaggggccccaaggacttgcatgtgccctgaggacaggctttccctgcccactgctgctgctgccactaccacctgagcacactgcccagggcctggggatcaccctgtcctgcccaccgaagcctttgcccatgtacaccattgaggggacctgggaacaggtctgccctgcctggcactgctctcccagcccctgagcatgctgcctaggagccagagtattgccccaccctgtcagttgttctcagagcacatgcataccaccagtgggcccaacaacaagcccagaaaacctgccaccagcacccaagcatgccatttggtccaccattgctggcatctggacactcctcctgggggccttgaggatgggcccacccagcctgctctaccaccactgctgatacccacccacacatgccacctaggggcctggggactggccctcccagccaccattaacaccagtgaatgacatcttggagcccaaaggctgttgcaccaccactactatcattgcccacaccaagcatgtggcccaggggctcaaggactctcccacctacccagtccaccaccgacactaccagcacccaagcaaacctcctagaggcccaagagtgagcctgcctggacctgctaacaccaatgctcatgtatgccacctggcagcccaaagacagaccttcctaggccactgctgccaccattagagcctgaggactggcccatctggtgttctgtccccagcaaaacttcaccacagccaccactagcagccatagcctaagccactaagaaaatcacagataccactgataatgtttgcaaccaaagacatcatacacagactacactacggcacacaccccgaatcaaagccaaagtgcattactcaactaacactgtaggggaggactttttcctgttaaaaagtcttcccctaagaaaaccaatccaaggctggatgtggtggtttatgcctgtaaaccagcagtttgggaggcggaggtgggtggatcacctgaagtcaggagtttgagaccagtctggccaacatggtgaaatccagtctctactaaaaatacaaaaatcagccagatgcagtggcatgcgcttgtagtcccagctacttgggaggctaaggctggagaattgcttgaacccaggaggcagacattgcagtgagctgagattgtgccactgctctccagcctgggtgacagagtgagactccatctcaaaaaaaagaaaagaaaaaaagaaaagaaaagaaaagaaaaagaaaaaagaaaatcaatccaaaaaattggaagaagtcattgttataccacatagggagatatcaatgaaaggacacaaacaagaaaaagggaatatgacagttccaaaggaggacagtaattctccagcaacaggttccaatgaaaagaaatttatgaaatgcctggaaaataattcaaggtaatgatattaaagaagctcagtgaaatataagaaagcacagatatataatataaaaaataagaaaaacaattcagggtatgaatgagaaatttcactgaaaagaaagatgcaaaaaagaaccaagagaaatcctggaactggaagattcaatgaatgaaataaaaaatacaatcaagaacttcagcaatagactggaatcaagcagaagaaagaatttcataacttgaagacacgtcttttgaaatacctcagccagacaagaaaaaaataaagaataaaaaaaattaagaacacctacgtgacacatgggacatcataaaatgaccaaatattctaattttgggtgttccaaaaggtgaagagaagtttaatagcatagaaaatctatttaacaaaataatagctgaaaacatcccaaatgtagtaagagatttagacatccagacacaagaagctcagctatccccaaatagatataacccaaaaaggtcttccaggcacattatagtctgtcagaagtaaaaggccaggtatagtggctcacgcctgtaattgtagcactttgggaagtcaaggtgggcagattgcttgagcccaggagtttgagaccagcctgggcaacatgacaataccccatctctacaaaatatacgaaaaattaaccaggcatggtggcacatgcctgtagtcccagctacttaggaagctgaggtgggaggatcacttgagcccagggaggtcaaggttgcagtgagtggtgatcatgccattgcactccagcctggatgacagaatgagaccttatcttaaaaaaaaaaaaaaaaaaaaaaggcaaagacaaagagaattctaaaagcagcaagagaaaagcatctagtgacatataagagaatcctcatcaaaccaacagtggatttctcagcagaaaccttacaggccatgagagaatgggatgatatattcaaagtactaaaagaagagaaaaaactatcagccaaaaatactatacccaacagttatccttcataaataaaggagaaattgagacttatccagcaagcaaaaactgaggaaattcatcaccacaacaatcagtcctacaagaaatgcttaagggagtcctacacctgaaagtgaaaccataatatctaccatcataaaatcacacaaaagtataaaactcactagtagagcaaacacaagtgagaaagagaaagaactcaaatgttaccactatagaaaaccaccaaaccaatgataagtaataaaagaagaaaaataaagaaaaggatatataaaacaaggaaacaacataatgacaagaataagccctcacatatcaataataaccttgaatgtaaatggactaattttccacttaagaggtttagactagctgaatggattaaaaaacataatcctactatatcctgcctacaagaaactcactttgcctgtaaagatacatatagactgaaagtaaatggatgggggaaaaaattccatgcaaacagaagccaaaagcaagaaggaatagctatacttatatcagataaaacaggctttaagtcaaaaacagttcttaaaaaaaagacaaagaatgtcattatataatgataaagggatcaattcagccataggatataacaattctaaatgtatatgtgtccagtgcagagcactcagctgtataaaacaaatattattagttctacaggaaaagctagactccaatacaatcatagttggggacgtcaacatcccactcttagcattagatagatcatctagaaagaaaagcaacaaagcaacattggatttaaactgcattttaaacaaaatagacctaacacacctttgcagaacatttcattcaacagctacagaatacacattcttatcagtaccacacggaacattctccaggatagatcatatattaggccacaaaacaagtgccaacacatttttttaaattgaaatcatatcaagtatcctctcagtccatactggaataaaactagaaatcaataacaagaggaacttgggaaactgtacaaataaatagaaattaaacaacatgctcctgaatgaccacagggtcaatgaagaaattaagaaggaaatacaaaaatgtctagaaacaaatgaacattgaaacacaacacaccaaaaccaatgagatacaacaaaagcagtgctataagagaagtttatagcaataaacacgtatatccaaaaaggagaaagatttcacaaaaccaaaagatgcacctcaaggaactagaaaagcaagactaaatcaagcccaaaattagtagaaggaaggaaatgacaaagatcagagcagaactaaagaaacactaaaaaaaatacaaagggtcaaaaaaaaagttgttttttaaaaaagataaaattgataaactgctagctaaactaaccaagaaaaaaatgaagacccaaataaaataaaaaatgaaagaggagacatcacaactacaccacagaaatataaaagatcatcagagactactatgaacaactatatgttaacaaactgaaaaacctggaggaaatggataaattcctggatacatacaatgtaccaagatttaataaggaagaaatagaaaatctgaacagaccaataatgagaaacaacattgaatcagtaataaaaagtctctcaacaaagaaaagcctaggacgtaatggtttcactgccaaattccaccatacccaaagaattaacaccaatctccttgaagtattcccaaaaaatgaggaggaaattctaactcatttattgaggtctgccttaccctgataccagaaccggataatgacacattgaaaaaagaaaactagaggccaatattcctgatgaacatagatgcaaaaattctaaaaaaaaaaaatactggcaaaacaaatcgaacagcacaggaaaaggtaatacaccatgatcaagagggatttatcccagggataaaataatggtccagcatacactaatcaataaatgtgatacatcacattagcagaataaaagacaaaaaccacatggccttctcagtggatgcagaaaaaatatttgatgaaattcaacatctgttcatgataaaaactctcaacaaactaggcatagaaggaacataccttaatacaataaaggtcatatatgacagacccacagctaacattatgctgaatgggaaaaagccgaaagaccttcctctaagaatttggatcctcaatcaaatactatttggccataaaaaagaatgaagccagccgggcatggtggctcacatctgtaatcccagcactttgggaggccgaggtgggtggatcacctgaggtcaggagttcaagaccagcctggccaatgtggtgaaaccccgtctctaccaaaaatacaaaaattagccaggcgtggtggcgggcccctgtaatcctagctactccagaagttgaggtaggagaatcacttgaacccgggaggcagaggttgcagtgagctgagatggtggcattgcactccagcctgggcaacagagtgagactccatctcaaaaaaaaaaaaaaaaaaagaaatgaagccatgtcacttgtggcaacatggatggaactggagatcattatgttaagtgatatttgtcacacagtaagacaaatatcacatataatcactcatatgtgagagctaaaaaaataggttgatcttacggcggtagagagtagaatgacagttactacaggctgggaaggatgtgggtgtgggagatgaagagaggtttgttaatagatacaaatatacagttagatagaaggaataagttcttagactgtgaatttcttaagagaaaaaaagaaggaataagttctaatgtttgatagtagaatagggtgactgtaattaacaacaatgtattacatatttcaaaatagctgaaagcaaagacttgaaatgttcccaacacacagaaatgataaatgtttgaagtgatggatatccttaacaccctgacttgatcattacacattctatgcatgtaacaaaatatcagatgtatcccataaatatgtaaaaatattatgtattaataaaaataaataaaaattttaaaaattttaggtaatttataacgtgcagccagggttgaaagccagtgctccaatttcctggtctttattattaaaacccatggtttatgaatacattacgctaaagtccaacacagcagttctgggtgctgttgtgagccatggtaaacaaggggtgtatctgagccccagctctccagtgatcagcaaggacaggccacctgtgcctccaggggcagcctctgtagagtcacagatcctctcagtgcggagaacctgtcttggttcctcaaggggaaccaagggaagatattccagagggctcataggtcagggacctggtcactatcctttcagcacagctgtagccctctgtgggcccagggaagcctgatgccagctgccccagggtaaagccttggcagatgccaagtgggagaaggaggtggtgttccctcggggagagggggaaatgctacacagagcaacatgggattcatctgcagaagagaggtcaattgcttaccctactggaaccaaaaagtctcttggcaaagggagttctgagctgataaacacaggctcagtcttccagaatccacactgcaggctgagaactggaaagacagtagggagacttattgctttctgggtgttttgcccagaatctcccttctggtaaagcactagggtgggtagtaggactcactctttgatctttggcaagtccctcctactctctgggcctcggtttcccttctatataatgaaggagttgaatcagctcacccttaaggtctcttctggatgctgttgcagggtctacatgattcctgatgaatgatttcccctggagaagctgcacatctgtgctctgccccagtatttgtctggaaggtggaatttcaagctgcctcctggacttgtcctttcctttcagattccaaggccactgccctgtctgatggtcatccagtcctgattcacttccctcatctgagtccctggtgatccatcctccaggaagctcagcctcacctcaggtcctacagaatttaaatggcctcatcactcgcactccagggaggtgtggtgtggaatcttcctcaaggaccctgggttttaagcagcactggtgtcaccctctgttgccagcctaaggctgtccccaaggtccaggatctcagggcagctctgctgatctacagatttctctggacccacaggactgttataagtttgaggatgcagattggggtctgcttgtctcctcccaaaggctgatcctcccaggctcaggcctcctgaatgagcatccctatcagtccttcactgagtttcctacccctttccctacccagaatacttttctcatttggaaccctggacataacacaggcctttcttgtccccctcatatatgattcacttcaacagcctcctaacctgtttccttaaggctctctttcttctaccccctacaccatactacagattcatctccctaaaacagtcctgccttgggttagctggcactttgctcaaaaaccttcaatgggacatgaagacctctgtgctcagttcaaattctctgccaaccatttggggcccagaggcctagagcttcctggtttagggagccccttctgtgcatccaggtgaccccaccccgcggtgtggcagtcttgtctatctgcttcattgtcttaggctgtgtgtgcttccccagcttggaatgtcctccactctctccctccattttaaaaattccatcatccagccaggcacggtggctcacacctgtaatcctagcactttgggaggccgaggcgggaggattacctgaggtcaggagttcgagacaagcctggccaacatggcaaaaccctgtctctactaaaaatacaaaaattagctgggcatggtggcacacacctgtagtcccagctactcaggtggctgaggcaggagaatctcttgaacctaggagatggaggttgcagtgagctgagattgagccattgcactccagcctggggaacaagagcgaaactatctcaaaaaaaaaaaaaaaaaagcaaaacaaaaacaaaaaaaaccccattaaattaaaaataaataaataaataaacaaaaattccatcatccattcaagattcctgctctgtccctacctctgccaaaagtctgttcagactattccagcacatactggtctcttcatccttttgtttcttttctgactccatcagtaccactatttcagttgtacttgaagatactgagctccttgagggtggaaactgtaacttatacttgttttgtgtcccatgatgatgcctagcaccagggctttgtgcacagtggggtgggagacactcatggctgcccacgcaacagcatggctttcttgctgaccaatcagcctctactacaggagggtgttgaggagggaacctgaaagctgcatttgccagcctcccatgtacaaggacagggatgcatgatccactccttgcactggagcctgaagggagttctgacgggaggtgtgggagagattctttcctgtgtgaggcaggaaactcccctacatctcaatccatgcaaatcagtagggaaccaataacagttcctacctcctcccagccttgagctaggaccactgaactacagcatcccccgaggctcattgtaagctggtgagacctcagaaacaagacctagaagctcataaatacacagggcttggttttgtttcatttctgatagttcatcgagtcaatgaccaacaattaatgctttagaagaagataacagtctctgataatggacctacccactcatataattctggaaaatatgccttcctgacccctccaggcaatcagctcataccatgaaatatgaaatccacgcatgcataactgtgaatgttattaacaatcataaaaccatgcaactccttcggaaatccaagccttatttccaatacaaattaccccctgccacagactgggttattcaggatagaaagaagtatttcctttcctttgttaaaatttacgagtcattaattctactgaatgagaggcttctcatattatagacaagttgaagcttttttcctgaggggagagctgcatatggaaagttccctgtttgggtctagagatgtccagcaacagtctttgataacctagaagagttcactgtcggttccattaatacccatctgtaagtacaagttggtaccttggctgagtaggagctgggacctgtatgctcatgggtagcggggtgaggcaacacatcaactcttacccccaacccagtatctacttgcaagcactgatcaaaatgatcgggaaatagtttggtaaactctgggatagcacataggttgcctgaccatactccactgattcccagtgttctgggagctccctctcctttaacccctcatactgccactgtttacatttcaataggagcagacaagttcctgctgtacgactctggtcatcttccccactgttgaatggatcagcacctgatcaaaactgggtcaatcaattaagacatcttcccaaatatttgaaactagaactaaaagagatcagcttctccctgaacttcctggacaagtaaactcaggagtggtccacggccatgttttctgcaaaagaccatatacaaaaacagagaaggaaagagggaaacagatgcaagttggagggaaggggtgctgttggcttcctaccccctattctagtctctattcataatctagatctgaggtctggctgtgtctcttcctttagtttccaggaaacatccctgatcccataacaaatttccttcattaaaaaaaaaaattgacactcactcaagtggatttttgtgattttctaccaaaacactccaaatacacataacattgggcattatataactgttaaaagtttgcatataggcctaggtatggtggctcatgcctatactccagcactttgggaggctgagattaaagaatcacctgagcccaggagttcaaatcagcctaggcaacatagtgagaccatgtctctacaaaaaaatattaaaattagccaagtgtggtggcatatacctgtagtctcagctactcaggaagctgaggtgggaggatcacttgagtcagggaagttgaggctgcagtgagctgtgataccactgcactccagcctgggtgatggaacgagaccctatctaaataaaacaaaaatttgcttataaataatttttagtatcaagggagatggcttctgacatcatgataggtcattaaaaatcaagctataaaattatattaagtgcaatcttaacaatataaaacaacggaggagttaaaaaccatcaaaacattatttgtgattatgtatttcttttttgagacagggtctcgctctttgcccaggctggagtgcagtggtgtgatcccggctgactgacacctccacctcccaggctcaaacaattctccttcctcagcctccagagtagctgggattacaggtgcatgccaccacacctggcttatttttgtatttttagtaaagatggggctttgccatgttggccaggctagtgttgaacacctggcctcaagtgatctgcctgccttgacctcccaaagtgctaagattataggcatgagccaccatgccccgcctatttgtgattctttctaagtagtgggattgcaggtgagttttattttcttcactgggtcttttttctctatgtactttacacattttttataaaaagtatgtattaattttataatcataaaatcagatttgtttaaaagtcaacatatttaagaatctttccctgcttccttctcctttcccaaaaagtctgcagcggaagacccagtttgagtccaagtgtgttcaccaacaaaatgtaaccatgtctagagaacttggagggatctgttggcatgagggggtaggagcctgctagtaaaaaactcactcacacaagagtccagataccaagttggcccactgatggaaccttggttttcaagtgaggtgtaattccatgtatagctgagtgtccatccctcagacctgctccagccagtctcctgtggctgagggcacagcaagagagtgtgaattagaacggaaagtgctctttcactgaaaatttagggacactaaggggtatgcacagctttcacttggggttcttccaatagagcataacatttcaaggagtacagatactgtacctcttgctcattttgctatagaccactataccgccttgacactatggggcctggggtattggcactggtgtggatgatggtgacaacaaggcatggcagaggtggcagcatccaggagtagcagcagtcatgcatgtgagctacagcagatacagtgacagcttctaattaatgcagaggaatggaagagtcccacagatctgcagtgatgtccagcaaaggccaatgttcagtgggaaggcaggttcagtgttagaaggacaggagtagagaaaacagaataggagggaaggaacaaaatgttagtagctgactggatggctgaatggaaagctgcaagctaaagctaccccagaaacccttagtagacggctaatgccttgttaagaattttaccacctggccattcctgctaaagaggttggaaaagcaagtcttcaactttcccttttttttttttttttatacggagtctcgctctgttgcccaggctggagtgcaatggcacggtctctgttcactgcaacctccgcctcccgggttcaaacgattctcctgccccagcctcctgagtagctgggattacaggtgcctgccaccacgcccagttaatttttgtatttttagtagagatggtgtttcaccatattggccaggctggtctcgaactcctgaccttgtgatctgcctgcctcagcctcccaaagtgctgggattacaggcatgagccactgggcccggccaacttttccattcttaatctagaagtaagcaaggaggagggagtattcagactgagtattgacttgataaaggtgattaaaaagtcagtatcagattagggctgggcaccgtggcttatgcctttaatcccagcaatttgggaggccaaggtagaaggatccttgaccccagaagtttaaggctgcagtgagatatgattgcaccacagcatgccaacctaggtgacagagtaaggcctcatctctaaaaaaaatttttttagttaaaaataatcagtatcagattaaatacaggcaggtattatggggaaaatctagaagggttctgcattcagatttggcttatgaaacataaaaagaaaatatcttatccctatatcaaaagatagtgaatggacattcatttatatattttaagttaaaatatttaacacacgcttatgtcattctttataataccccacagtaactggcaatttccaacttgtcaactatagatcctatcacaactggtagactgagcagacttctattacatccttcttattttgaaaatagctttattcttttaaagatttaggcttattataaatattgtgatcatacagaaatgtacaaagaacaaagcaaaattcagctgttagggtgaacatccttccagacatccctccatgtgcacctattaaaatattatacaaatgggatcatgctgttctgttatcccttttttgcactcaattatacatgtcataggcaaattttcatgtcatcaaatctacatcatcatttatatattgtctatatggaagtgccttaatttctttatattttttaaaccaatgatttaaccttattgataaccatccacttttcactgttataaacaaggctgagatggaaagacttgtctttagatctccatttgttttggcaatgattgtccgggggtaaattacaagaagtgagatcactgggtcaaaggtacactcatttgaaatgttcattcctgccagcccagtggactgcagaaaggctgggccaatttatgtcaccaccagcagagcataaaagggccgggctccagcccctcaccagtccgagattttgtcattcttctgtttcctagagtaaaacttcagaaggattctcttcatccatcttttgtctactatgttcttttttgtagatgcttttttgcataggtttcatgctgagtttttttctgcctatctttaatggagagcagttctctcagggtttaccatctgcttgaaaatggtatgcatgaaatctccttgactccttttcctgttggtttggttactatccgaatcttcacttagcatttaagttggaaggctagaatctaatcatgattttcccctgtttatttgccagaaagacttggtgaaggcatagaaccttgatttatctcctaaattgttgccatttctgctacctggacaacttggtcaagttggagaagtctgggttttgccttgtctcccctcttctgggtaggctaatgagaggtgcgtgagcaatgccaggtggttcgtaaagtgaatctgcttctcttttaaaaagagagtgagccaattgagacaaacacaggcaaaaacccagctgcagcaacatcctcctggctaattggatcctacctgggaagggccatcttctagatagcttgttcccaagcagtgttcccagctggcccctcaggaagtattaggcctgtccttggctaatcccacagtttagcgttgacataattctatctgacccagtctccagaaagactcaaagacttctcagctaatagctctgtcctaacatctagaaccacaccctcaaagatgagatggtacccctgatttccacaatcctctcctttgggacacagagcataccatccctgactgcaccagacatagttattctctgcccatgggctactctttcttctcaggaggcctcagggcaactgtggggtctcctgagaaagccatctgtaggtaatgggaccaggactatcagaggatatcatctatgaccacagtaggtgggcaagaagcagagttagttccctgttcagaatcagagccccaagagactggcaggacattcctgtgagaatcacagtttgttttaggaatctcaccagccacttaagaaaatacagatggccaagagcaccccaggaccaaggtcattgactgattcagtaatacctcttggccttccacctctgtatgaatttgttattgctgccaggacaaattaccacaaatgtgagagcttaaaaaaaacacccatttattatttcacagtttgcaggtctggagtttgacatgggtctcactaggctacaaggtgtcagcgggctgttttccttactggaggagggtcacttacaggttcatgaaggttgctggcagtgtccagttgtatgtggttgtagcactggggtccttatttccttggtggctattggccctgggtcattctcagcttttagaagccatccacattccttcacgttctccttatctttgaagccagcaatagagagtcaagtccttcttgtgccttacctttcctgtcttctcttctgctgtatctcttcaactaggaaagattcttctccttttttttttttttgagacagagtctcgctctgtcgctcaggctggagtacagtggcgcgatctcaatcttggctcactgcaaccttcacctcccaggttcaagcaattctccttgcctccacctcccaagtagctgggattacaagtgcccacaaccaccgcccccaactaatttttgtatttttagtagagatggggtttcaccatattggccaggctgttcttgaactcccggcctcaagtaatctgcctgagttgacctcccaaagtgctgggattacaggtgtgagccaccgtgcctggccaattcttccacttttaagggttcatgtgattacacagagcctacctggctaatccaggataatcttcccatcttttttttttttttcttttttttgagacagagtctctctctgtcacccaggcgggagtgcaatggcaggatctcagctcactgcaacctccacctcccggcttcaagcaattctcatgcctcagcctcccgagtacctgggattacaggcacccacaaccacgccccactgatttttgtaatttcagtagaagtggggtttcgtcatattggccaggctggtcttgaactcctggcctcaggtaatccaccagccttggcatcccaaagtgctgtgattataggcgtgaaccaccacacctggcccatcttaagatctataaccttaattgtatctgtaaagtctccttgccatgcaaatttaatatattcacaggttccagggatgaggcaaggacatctttggggccattattcagcttaccatggcccttttggccaagagtcatccaggagtaagagcccggcagagataattccaaggaagacccacatgatttcctctcctccatccccctcccacaacacacccatccctgggaaccagttggccagatcttccagctgaatacttcaccagactcatgccacaatgcatcactatcaaggcgaggctgagcacctggcacagccaactccctctggagagctggggcaaggctggtactttcaacccaagccctgagtggcctgtctgctcactgctgtttcctgaagctcagccaatatgcctaggaggatcccaaggattttgggcttcagtccaatatgcctataagcagaaggctctgctttccctttgcaggagacggttagaggcttgggttagggtctcggtggaattataaatagtataatggcattactgctagggacccaggaaggctaaaatattgtcctgccaatcattcagcaccccttggcatctcatataaggaggaataaaaggatgtaaattaaaaatgtctttttttttttttttgctagccttattggtagctgaaatgtcaatgcaaaagctggagaaagaacgactgtatcaggtggctggttccccactctccctcctcttgaagctaaatctggtggcagcacacacaagtatacatgctaaggagagagcagggcccaactgaacttacttattgactacatatccaggaacagagaggcatggccaggccctcactgagatggcaacacaacctgggtctgctcaccacatacaggaaggaagcaaaagcacaggaagccccaaagaccgagaccttcctaggaccaaagcgggatagaggagaaaaggtgttgcctttaatgtacagtgacctggtggtttaccagtaaaatgtggcccagtgaatattctggactctgacctgtcagattagcacctgttcttcctttgggcagggaggggagctaggaaggcgttagaaagaggctgtgctggtgtgtgcagagtagacagtggggggtttcactagtgcctgcctttgtctgcttctggtctcaacccagtggctgcccctaggtttctggggatggatgatgagagtactgttgacccatgcgcttgtgagccaggcaccttggtaatcagatgcccagcggctgtgagttgtagctgaccacgcccaccagaggaagaatatatcacccagggaaggccatttaaccagagacatgcaatggtgtagccactctgagaccttctgatctacaatgctggggtgagctgctccccgaaatgcccagatatcctaaactcctgagattcaaaagaccatgcagactcttttgcaccatatttctgtgcggagatctttctggcttggatttggggaattcagacagtttcccatgttcaaagaattatcaagattctctccaggaagatttcactgatgcccaggtcagagtttgatgtcctacctggtgctttcctgcctgccccatactgcactgaaatcaccttctgttggtctgtcttgccgagaccagctcagttgtggagaccctaacccagcagtgctagaggaattaaagacacacacacacagaaatacagaggtgtggagtgggaaatcagggttctcacagccttcagagctgagagccttgaacagagatttacccacatatttattgagagcaagccagtgataagcattgtttctatagattatagattagctaaaagtattccttacaggaaataaagggatgggctgaaataaagggatgggtttggctagttatctgcagcaggagcatgtccttaaggcacagatcgctcatgctattgtttgtggtttaagaacgcctttaagcggttttctgccctgggtgggccaggtgttccttgccctcattctggtaaacccacaaccttcagcgtgggcatcatggccatcacgaacatgtcacagtgctgcagagattttgtttatggccagttttgggggcagtttgtggccagattcgggggcctgttcccaacactgtctcctctaataaactgtgaattccttgaagccagggactgcttttttctccattttcttccctggcctagtgtaggatgtcacacagtaggggcttagctagtggctgatggtggacgctaaatgattgaaatagctatcctaccccaaccagtcccaggctgggttcctggcacaggctggcatttgtacatgaacaccatggctgcttgttccactgtggcctcagctcccacagcaagtttctcctacagctgaacctggctggaaatgcaggcataagagcccccggagggagccagtagtcatcacagccaaaggtctttgggaagccttcattaccatctgggtatgccttgccaatctcgagctccccaggcttggcactttttaggacagcctttgtcatggtctgacagacatgacagctctccctgtctcacactatctgatccagtcatattgagctttcatattggaactctctaggacctactcaacctaggcaggcagatctcttttatttcatcacattgttgaagatgccagaactttgggactaatgattgatcttagaggttggaatgcacagccagcctgccagtcagatctcctcctggtactttgctgcccttcctcttgtctcgacctctgtctgctccactgatgcccatcacttggtcctttcatccgagaaagaataagaatggaatcaggtgctttgtagagtccactttataaaagaatgggaagagcttttaaaaattccctaccaagcttgacccactaggcaataactcttactcaatctcattgcttcatgaaatttcattgactccctgcaccctccatctccctgctccaccctaggctacttccttggcactgatcttattccaaggactgggccaggcccatgggtacacatagctaaccattccccagtccctggctttcagccaccatccaaggctggttccctgctctccccagcacttctccagttctactctgatttgggccatatagatggaaaagggatcagctgggtgactaggcaggtaatgaatcccaggactgtaggacacttattgacacaacactggggtagtggagactcacagaaaatacagaaagccttctactttttcatctaccttccctgttctccaactgagtataatttcatcatctgctcagattggaagtcatatggcctccttgtttgtttttctcatcttactttacccatagttttggtaagaaattggtgaggagggttggctcttggaggtttttgagctaaagatgacatgatcagagttgctctgtggtaaaactatgtgaggatggaggaagctgaagaccagtttgaggttactcatgtaggtcaagtgagggatctaaacttgaatagaagtagggtatgacaacatggggacgttgatggtacaacaggtgcaaaatattgtggaacaagaactgctagaggtaagagggattggatgtgaaatttgtggagggaagaatctgtgaaaacactaagattaacagcttggataattaggactgtggtggtgacattaacaaaacactgaacacaagtaatatatgtttctagggtttctttctttctttctttctttctttttttttgagatggagtttcactcttgttgcccagactggagggcaatggcacaaccttggctcactgcaaactccgcctcccaggttcaagctattctcctgcctcagcctcccaagtagctgggattatgggcacctgccaccatgcctggctaattttttgtacttttagtagagactgggtttcaccatgttggccaggctggtctcaaactcctgacctcaggtgatccatccacctaggcctcctaaaatgctgagattacaggtgtgagccaccatgcccggcctaggggatcattttgagctcattttgtgatctactgagtttgagtaggatctccagacatagcattctaggaagcaaagaggaatactgggcatcaatttgagagagaggaagatcacagttatagctacagacatcatctacatagagagaacacttaaacataaaacagaatgaaagctgcaaaggaaaaattatcaggctgtcccctctgcctggaatgccctttcttctcatacctgctgctgcaggtatgcattgttggatgacaaccctaaaacttagtggctttaaacaacaattattttatagtaaactttcatggttttgagggttgactggccttagtagggtgcttcttgctcagaatgtctcaagtaactatcaccagtcaagttcttacggctgaaataatctcgatctctcttcctctcttctgtttctccagcatggtggctcaggaagtcagggtagccagacttctcacatggaggctccaaacacatgtcacaagtgagctaccgcaaggaggaagctgtatctccttttatgacctagcctcagaagtcaggcagcattacttctgccacattctactcttcagagaggcagtcataaaagctcactcagggtcaaggggtggggatataggctctacctttagatgggtaagtggaaagtttctataaggtcatgtgggactggaaattttttttattcattctgggaaaatctgtcttctcttccaaaactcaatacaagaaaccatcccaaatcctcatgcttggtataactgccactcttcagtagccttccagcattttacatcctatgacaatgtttagcactacaggcatcgtcatctggttatacatgtagccatctgactcaattgtaagcttctataagtcaagacccgggtctcgctctgttttggtggagtgcaaagtagcaggtagatctagattgttgatttaaatttaattccaaaaataggagaagactgtatgtggaaggttagtgaaagctgtatttgagacacaggaaacgaaataggccatggagacttcgaggggagttttttcaaaaccaaaccataatagtcttggcaaaaatattgtggacattttccttacctatgaaaactgtcgctgaataaaattaaccatatctatgataattagcaacaacaaaaacccctccacaattaatgctttgtaagcaatagctactgaacaagtttcttattttcataacagggaacttctgaatagtcaaaccttagaagaaatcctaaccataaaacagaaccaaatttgcaaggattgttttcccatccaaaacttatggtataataaggcataccataatcaaatttatcaatgattaaataatcttaaaataagactaagataccattttttgcctatcaaattgggagagcttttaaaaatattcgtaaaatggcccaatgccaccaaatgaacgttcagacatttctgacagacgggagacttggccaagccttctggaagataaagagctgttaagagttcgctccctttcattcaggaattccagcactagaaatttattctaagaaaataatcctgggtagggcaaaaattcatatcgaggatgctcaacaaagtatatgttatgatagcaaaatgctggaaacaactaaatattcaaatagagcttggttaaatagattatgattaattcacttgctgaaacattatgcagctatttaaaaaataacatttttgaaaactcttttctagtacaagagcatgcttacaaattgatgttctctgtaaataaaacagaatacaaactgcacaaattataggaagtagtatgatcccaattttgtttaaaaattatatatgtatcgagaaaagactaaaagcacattccacaaaatgttaacagtagttatgtcagagtgatagaattataggacgtttaaatttttttccctatgcttttctgacttttttttttttaacaataaacatgtaatacttttgtaaccaaggagaaaaatgtattttttgaaaaaaccccaggaattgcttctgtgactagctaggtaattaacaaaatggagggaatgttttcctggaaaaaaaattaagtaatttatgatgaagttcttggtatagaataactcacactttcaaaaaaacctaacatgcaagaaagcagcctggacacagacagaagcgctatctgtgaggcgtgaaatttcacacatgccaaagcctgcacaggtcccacagtgtatttcctttaatgacacatgggaacttgtaagttctctggctgcaactaagacagattctaatgggcggcaggagtgctaagctgtgcctttctggttctaccccacacttctctaccccacaacaaggaacaagttgattaacctctttgagctcctcaagtccctctctgatatggaaatccactaacatcaatagggcgcctaagggcaaaagtggaagaaaataaacactacaaataagatggctttagatagaagcccaggccagtgcaacagggacattacacagctgtctccaactgaactgccaacacccttggctgagagtctgcccagggtctcgtttcatactcctctcattgtaacactgctgtaggtacccagggaacagctgagctttctgcaggcaaacagagctgcctggggcccaccactgctcctctgataagacaggcctctattgtaggaactaattaccacaatgccataaagctatctgccctgggccgtgcatcagaagtggtgacaggctcataaaacctgacttccctgtggataccaaatgccagccctaagggaatatatggtcagtattcaggcctttccgagtttgcaaataagccagatcctaaaatcttgtttgtaaagcatcatgaggaacctgaagtaccagagaaaccatgttctaaatgtagaacagacatggcacatagtagatgctcaataaatatttgatgaccagtgatggccaagtggaggccaaggtccagttctagcccttagaagcatttgaacaaaatgtagctgcaagctgcatatttttcaatataggaaacaattttgtttaataccagcagctaaaagacgactatccacaggattaaataattgaataattagtcttaactatatttatctaaatctgtttatggagaagaaagcagatttaactagaggaagataagaatgtagactgtaggaaagactaaggcagaatctaggcagtttcaaggagtttaaagatgagtgacactacgttattattttacttttcatgtcctttatataaacagcacttccttttggctggcagccaagttgggcgtcattttacaatgattacaagggaaaagaggagaaatgataacgaagccgtgttaatccatgctgaaacagtatggagtcacacggtccccctgtcaacacacccagggaagagcccagccaggaccaccacacaaatctaagatttaagacctggttgggccactcaccagctctgtgacttgggaccagaaacattctccctggagctttaatcaccgaagcataagagtactcattccatgaagccattgggagggttaaataagatcatgcatttaagcactcttacactggcgcataatacatgctagttatggttattattagaaatgtgttctaaccttttcctctaagtttcaggagggtgggacccacgtgttcatctcatttactactgtatacccaacagtagtaaacctggcatgtggcagggatttaacaaatatttgtaggggacaatctgcttgttctcatttttttcctctggtcagtgacaaagtgtttttctgcatctatctctgtcattttttggtcaagtggtttataattatagacatcatgacccttcatccttaaatatttcactgtgtctctaaaaaataaggacattttctttataatgatatcatatccaaaattaataatttgtaaatatataacacctacacggtactcaaagttcttcaataattccccaaaatatcctattacagctcatttccttatgccagctttattccttgactgaataaaggatcaaaactacattcggtgattaggtcttttaagtctcttttgatctaaaaatagcacctccactcctttttgctttctatgacattgacttattgaagatacagctgtccctcagtatccatgggtgatcagttccaggatgcctgaggataccaaaatctgaggatgctcaagtcccttatatcaaatagtgtagtatttgcatgtaccctacacatatcctcccatatatgtacttcaaatcatttccaggttacttatagtacttaatacaatgtaaatgctgtataaatagttattgtattgctttttaatttgcattattgtttttatttttagtatttctgatgcagagttggtggaatccacagatacagaaaactgaccgtactgtagaatgtcccacttttttgatttgcctgattgatttaccactgaggtgatgcctaacaaattcctgtctcccctgtatttcccatgagatggaaattaattctacagtcttgatgtgattcaggtaaaaccttgttatccagaaaacctcatagatgatgctatgtactttagcactgtatcacacaaggagggatgtcatgtcaagttggcctattatcagtgacactgggcttgatcactggattaaaatggtgatggcttgcctgatccctttattgcaaagttaagggttttctcctcttggaactagcagataaactggggcggtagttgatgccctgtaaatatgtagctcaccattaacctctcaccagctgatcttacaaccactgatggtctttgcctgaatcaatcatcccataggggttgcagaatggtgattttccaatcccatcattccttcttcacttattagcgtgcactcttctgtaaaagagctttccttcatcaactgggctatttagttaccctgaaatatatagctcctagggaaaagacaggttatgtactcgtaactctttcccctgcataacccatttttaaaataagttattggtaaatagcatattttaaatcctggggtaaaaaggtttttctctctcctctggctccaataattgttttagcatgagcctgggaaagggtttggggccagaagtgtgagattacttcccattctgcttagtgggaagaaatcacacctcccattttaccccctctatgactcagattccttctcaagttagctgatcctaagtcctaagattaaaagttacggtttctcagcagatcctggttatatgatttataaatttggtgctaatctttcctctgtcattggaggtatctcataacatgatttttccaatgcttccctaggaagagtatttattccacaaactgatggaattcagtggcatgtatttctctctttgactgcaaattttattttaagcgttccagtgagaactcttaattctgaaacctcaaatcagagtaaataactcccctccttctcactgactacaccatttacacgtggctgggcccactgctagcataaaacctcaactctctgcccagccgagcagcatacactgctctgagctctttaatatgtcctcataaatccagctcctctcactgccctcggattccctgtacctctacatttcctccccaataactgagctcagcacggctgcaatgtggtgctcccttcctgaaatcagatgcagagtattctaccctctctttgacccctttgcctccatgctgcaacataagctcccatctaattgctgctctgcctctctcagcagaacctgacctctttctgggtccctctcttaaagcaactgtctgtgtttttcattatgtttgccaagacatattatcttgaacttttcccagatgaagctcgtttttttactttttcttcagacccctgaggtggcaggttcaagaatgcagtcttcagagggaagcttttggtctaggaggcttcagccaggacagttcagttaatcatactctccctccgggtactgcccctttaagaagtggacagactctggttccaactccaaacctcagttagaagttcaagccacaagacgaacacacatgtcctgcccagaaagctgcccagccttgctgttgactttctcctgacagcttgtcatccacatacccatcccacgcaaacgcaaacatatccttttaaacatcgaagtctcaaagcctcccccatgaaaaggaagttgaaagtcaagttccgggcaccctcggcttctgtagtttgaccagtaacctggtaagaaggggcacctcctttgacaacccgagtgtgcccaacaatgccaatgagaattctttaatgatcactcggaagatgtcatctctgtgtctcagcgaatccttctcttaaaaagaaaagcactcatgagactggaagaagagggggaaaactcagagtgataagaatgctaatcagaacgaagggaattttccagcttttagctttcctagcaaaaaaaaaaaaaaaggcatctataaaaaagtgttggaaggcttttcttgcagcctggggcctttgccagggaacagatttctctccctcaactcagtttcttccagacctttttcctgtgcattcttttttctttcttcttctttctcttctctcttagcggagcctcctccggctgagaagtaatctgtggggagcccgaggggtctgtactgttcaggccctggaaagagatgaaggtaactgcctgctgataggggcactgcaccatttgggattgcagtagggagaccccactcctcaactggagggattcatagaggtcacacccagggcttccttgctgctttttctgtcacctcccatgctgttttcttcccttcggtgtaagccagccctctctttttgtggtaagatgactatgggagtcccaggctggaggctgactctttgcacccacttcccacacttgtttctgacaagtctgatctgtgtagctcagcacatccaaggacagccttccccttggcttcgttgtccagatgcatgaccccaatggctttgtaaatgaaatggtataatctcaagaggctagcctgctgtagagagaggaataaataaatcaatatgtaaataaatccacaagagcagaggggatgtaccgggactttgcaaaactatgatgaagcattttagaagatggatattgctgtatttctggtgagctctgattgaaaggctatgattccagccatgggctgtaggagagggaaagtgagctgtgacggaaattccctcatggattgatttgacttaaatatattccaggagctgatctaattgctggttcagtcttaggctttgattttccttctcacaattccctgcatttcaaatagtttttattaaggggcctgagctgccctcagtcctactgagaatctttctggatatatgactaattttttttatttatttattttattttttatttttttgagacagaggctcgctctgtcacccaggctggagtgtagtggtgtgatctcagctcactgcaacccccatctcctgggttcaagtgattctcctgcctcagcctcccaagtagttgggattacaagcacacaccaccacacctggctaacttttgtatttttagtagagacggggttttgccacgttggccaggctggtctcgaactcccgacctcaggtgatccacctgcctcagcctcccaaagtgctgggattacaggcgtgagacaccatgcttggcctgtgactgattcttctgagaacacagtactagaaatactgcccttggtcaaaggaagaaccagacattccccacctgagaaggagaagcatgctggtaatttccagggggacaggtagttagttattcttattttgaatcagaagtgctggtggcagcctcttactgttcagactctgagacatattggtttgggggtacagtccaggaaaaggtgggaggagaacttccaatcaggtgagtcttatgcatggaaggccccagacactgacccctggagtctgaccccttgatcttctcatcagttcacagccctctactccacccctgctgccagtctcctctgcctgaccgcctgccttacaatccgatttatattctctttctctctctctctctccacacacttcctcctcctcttcttctggaaaatttcaagcatatacaaaagtagagagaataatatgatgccccctttacccatcacccaactccaacaatggtcaactcacagccacactttttttgagatgaagtctcgctctgtcacacaggctggagtgcaatggtgtgatctcagctcactgcaacctccacctcccaggttcaaatgattctcctgcctcagcctcctgagtagctgggattacaggcacacaccaccacgcctggctaatttttgtattttagtagagatggggtttcaccacgttggccaggctggtctcgaactccggacctcaggtgatccgccctcctcggcctcccaaatagacttatttcaattacatgcccagctgcttttaccttcactccttacctcttgctctacctggacgatcttgaagcaaatttcagatatcatgtaatctgtaattagtttagcatatagctccaaaagataaggactcttttggatataacaattccattattatacctaacaataagaataattcctaatgtctccaaatatctggccagtgttaaaatgtcctcagtgtctccatttatttttacattagttcaagtcaggatccaaataatgtccatacattataatcagtttatgtggctttaagtcttttcttcatataggttttcttttgctttcaaaatttattaaataaactaagttattgaactatagtttcccatagcctaaattttgcggatcaccagtccctgtggtatttttttaacacattcctctgtccctgttttttaattggtaattagatgacgagatttgttgaattcaggtttgattttttttttttttttacaataatgctttataggtagtggtgtgttctttcatcagagagcatataatgtcaattttgtgtgtgtgatattaccagcctttgagtgccattgtctaaatctatttcatgtatatcattaagtgttataaaatagtgacattctatcattctcttcatttattagctagactgcttctataaagagaaatttcctccattgatcaattggtcacctttatatcacttatccctgggaaatcttaggccacacagccagaatatgaaagtgctttgtggccagtgtccctcagacctcaaggtagattctacaggaggaaacggagttacccctcaaccttccctgggccctctgtgttcacttcttcaaagatattttaaaatccatttgccagccaagatattggccctgcttcaatgcaatataggttttgcatttaccaatgggaaaatctagataaatttgagtaactcagaaaacatttccattcagttgttttagaagccacccatgcagagtccagagctgcacctcacaccggtgtagtgtggcctatctacatgatgcttaagccatgtaggtaggaacccacacttccagggctgtcctactggttgcatgataaagaagatctatcctccgttttgaaggtactcagtcttgatcctgaggaggaagaaagcagagaatcctccatgcagagaggtcttcaccagctaaggacagcagtgaggccagagcccagctgctcaccttgtgccaccatccttgcccactgaccatgatggctctagttgcagcaccactactgctcacacctgccctggaacaacagtcctgctacccaggattccttgcaactgtagagaattgtaggctgcagctgggtgatttcacaacttgcttgcccacgcctgatgggggacacagaggtgagtcttctcacacaagctgtcagtagtctactcaagagttgtcaggaatgagggagacccactcaagcagataatatcaagcagcgagggctctgggacagggacagaccagccacttgcatctgacgagtgagccacagtaaactgaccagtactgcagccacacactcaaaagcatcactggctattggctgcatctgctatccagcccaagctgggactagggttgcctcactaggtgtatgaggagaagcagtggcaggagtatagtagcttctttatttttccacccaagcaggcaactgcagagagaatgcaaggaggggtatagagatgggcacaacccccctttgaatgccatcatgaaacatggcgcttggggacccagtcaggtgggccttgtgtccacctataagaaacatagggaaaggaattaaccagctgtactagagccttttacctaccacctaaatttcctctctgagccagagagtgtttctggcttctcaccaaaatgcaaggagattttggttaaaatccatcccattccaaatttgtgagacagactctggttccataggcccaatacaccacctgcttcaaatggtcgtagtccaggtggttgtatctgccaagcacccacaacagcagcagggtaatggggagtgctggtggaacctttcacctataggatgcttggagtcttacctgtggagtttaaggcgggtggcaagggttggaggggaggcatacatgagagcttggtattgttgctcaccttatgttcatgtttttatttcctgctgataattagatgtagctggcatgagtcccatagctctgccagcttcacttcagtgtcttggtatcaatgggccatgcaaataccctcatagcccacctggataggaaccacgcaaatttgcaacctttgagccatattggaacagaacttgtcaagtataaggctgatttccagaggctcatacccaggtttgcaggagttcaaaggcatatcaattccttgccatttcccggggactttctttacagtgagcagctcaggatgaaccaggcctgtcaggagccaacatggtgatgatgcagggctgccatttgcttctacctgacactagcatttggatcagctcagatcattcctaggacatacaaaagtggccctggtgggcacacagcctccattcatatcaggaattagtagaagacagtaagtgcagtgattattagtgctattcactaaatattctcggttctccaggctcatggtaaaattgcctttcctgatcccattgggtttgggtggagccatctgctagctttgccaacgaattgtgagtagaagtgacagaagttatttctatgcccaagtatttaattgctgggcaagacactcctctgctgaccatgatctctctctgtccctttgacatgacaactggtaatgtttgaaatggctgctactctgtcaacctgggtctcagagtaaggagcacagaggtgagcccttctgacccccactggatgagtagcattaccaaataaacctagtttgctataagcggccaagatttgaggatcatttttatcacaatataagctagcctatactgactggttcaactgatcagacatgcttgggacaaagcagctgtttaggatgaccttgaaactatacagccttcttgaagttccagggtctgatgtaagctcctgtatgatctcttggatctggagcaattatccactttaatgacacatccatcgactccctggcctggcttcctccagatatttctgaggcctcgcacccctcatgatgcccttcatactcttagagcatgagccaaggtcaatgataggtctaggaagcccaaggtatggtagacaaaataatgtcctacttcccaccaaagatgtccatgtcctaatccccaggatctgtgaatgtgttaccatatgtggcaaaaggtctttacagatgtgattaagactcttaagatggggcgattatcctggatttgggtgaaagagggaagcaggcatgccagagtcagagaaaagagttgaaaaatgctatgctgctggctttgaagatggagaaaaggtactatgtgccaaggaatgcaggtggcttctagaaactggaaaagccaaggaaacagattctcccttagggccctcaaaaggaatgcagccctgccaacgccttggttttagcccagtgagacccatttcagacgtctcacctccagaattgtaagataatagatctgtgtttttttaagccattaaatttgtcataaattgttacagcagcaataggaaactgatacacaagagaaaaccttctcctgttactgaatactttcaggagaccgttgtgaccatcaaccaaactttccagagcacaacatgcacttattggagccccctgaaaccctcaacaactgcaccctgacaatgtggcctattaatagaccccaattcctgcagtgagtatgatagagattcttctttatccaccatgtttgaaccttctgtccattgctcatcactctcaaatcattggagttcttgaaccaatgtactgtgtgtcttccttattgactattcgatttcaaccatgtagtagacaccagtaaatattaggtaaatatgaatgagtgaataaatgccatgaggaattatctgataacgtatgtagctctggatgatctgttgaaaatctccagcaagaaacacaccaatctgagttatacacagcaaaaaattaaaacaaaatagcaagcggatacaaaaaaaggatttagtgctttgcccactcgcagtttcgtcaggtgcaaacacaatctgtatgattctccttagttggctgattcttttgattccttctgccgtgcctgttgtctttgtgtgtgtgcttgcagaggggggtttctgacagtgcaacagatctgtcctcccctgggcacctgcttcctccagcttattcaaatttcactcatttgttagaaaagtagcatgattttgtaagcaaggatgttcagtgggacgagaatgaagcatacaaactcatatctttgtgactcaaatatagtttgattcattcatatttattccaactctgccactgaataataattatgaaaagagttacagtttgtgctgccgttaaacagtattttggggccaggcatgttggcttacacttgcagacccagcactttgggaggtcgaggcgggcagatcatttcagttcaggagttcgagaccagcctgggcaacatggcaaaaccccatctctataaaaaatacaaaaattagccaggcatggtggaacatgcttgtagtcccagctacctgggaggctaaggtaggaggatcacccgagcatgggaggtcaaggatgcagtgagctaagatcgtgccactgcactccagcctgggtgacagagtgagaccctgtctggaaaaaaaaaaaaaaaattgatgaggtaaaatcccattttaacaaaaataagcatatctcacttaacgtcaataatctgttcctgaaaaacagaagttctactcttaaacactgatcattattttaagggggaataatgcatttcgtgatgacccaaaactctaagataatttcccaaaacataattgaaacatggcaaaacgcctatatacgtaacaactatcagcttcgtatgtgaaatgcttaaagcactctctaatcaaagttttaataaaaatggatctcacatgtaaatgaaaaacttaaacttataaaagttctggaagaaaacacagaaaaaaatatttgtgactttggcttaaggaacaagttcttagcaatgatacccaaaatattcaacctataaaagaaaaaaattgctaaattggatttcatcgaaatttgaaacctcaactctttcaaagataatgttaagagaatgaaaaatgataaactgggagaaaatatttgcaaattacatatctgataaaggacatgaatcagcaatatacagagaactttcaaaattcgatattagaaaataatccaatgaaaataggcaaaagggataaaaagacttgatcaaagaatacatatgcataacaaataagcacataaaaagacagtcatcacatcgttagtcactggggagatgctctttacctgtattagaataactaacttttttttttaagtttcgctcttgtcaccccggctggagtacagtggtgcgatcccagctcactgcaacctccgcctcccaggttcgagcgattttcctgcctcagcctcccgagtagctgggattccaggcgcccgctaacattttttttttaaagctgagaataccaagtactgatggggatagggagcaacaggaattcttgttcattgcctgtgggaatgtaaaatggcacagccactttggaaggcagtttggcagtctcataaacagacaataatcacgtgatccagcaattctctcctagttatccaaaagaagtgaaaatttatgttcacacaaaaacctgtatataaatatttatagtgactttattcataagaatcaaagtctggaataaactcaaatgttcttcagctggggaatggataaacggactgtggcctatctgtacattagaatgttattggcaataaaaagggacaaactatggcagacaaataaacatgaacgattctcaaatgtgttgtgctaagtgaaagatcccaggtccaaaaggcttcctactatctgattccatgggtgtatcatcctgaaaaagtaaaactatgggaacagaaaacagatcaaaacacagaacagaaaactgccagggggtgagggtacggggaggagatgactacagagggacacgggaatttttggagtgacagaaatagtctacatcttgaccatggtggcgattacatggctgtcaaaacttgcagaactttgtacttttttaaaaggcagattttactgaatgtaaattacatattaataagcaactgccacaaaaccaacaaaacccagttgctttggtgtcgtagcatgtgcagctccatgacccttgaggaggctcagcacgcttttcaaaacatccacgtgtgattccgacattctagcatttgtatttagaaaggaagtgaagacttttctgcatgttgttttgttaaaatgttgaactgaggtttgagtatgtaaatattattttttcctgtgtaaacacatcagccaaaaatatattgacaaatacatatgttcaataaagctcggttattaaaatccagagggattctactgggaaaaaacaaaccaaagagacattcagcagggtatgccagtatcatgatactgctgaactctttttatatcctggctgacagcctataccatcactgttaaactgatatgtatacaacaagtcctattgaataaaaattcatctgtatttagcatatcttttttcagtcaccatcagttaaataagcaaaaatagagaaatccaaaggagctaaatagtttaaaaaataaagatgatttattaatattaatatattgatttctatatccagtacctagagagtgtattcttttcatgtccatggactatttacaaaaatgatattttagtctatgagatattctaaaatgtacaaatagaataaactacattctctgattataattcagtgctactataaatacataatgagaggataaccaaaaacttttaaccacttggaattaaaaactgcaattacagaatgttcagtgaattttaatattgtgaatactacatgttgagaattataagatgtagccaaagctgtacttggaaggaagtgtatagacttaaacgcctcaattattaaataagaaaagatgaaaataagctatgaattgagtaatcaattgaatatgtctggcatgtattaagcaatcaataaacatttagtgagtaaagcaattagagaaaagcaataaaacaaatttaaggaaaacaagataaagaaaaatattttaaaatgttgctaaatttgaaaacagaaaaattaagacagctgaataggaagcaggggcaataaaatagattatctactaagtagtcaattcaagaagaaagagcataactatataaaatttagaaaagaaaggagatgcagctacacacacaaattttaaagaattacaaattaatactttatattatgctatatacattggataatctaaatgaagtgagggcttttctaagaaaatataaattactaaaagtgtacaaaaagtataaagccaggagacattatttaagcaaagattgtggctcacacctgtaatcccaacattctgggagacccaagcaggagaactacttgagcccaggagtctgagaccagctgagcaacatagtgagacctcatctctacaaataatgaaaaaaaaaaaaaattagccgagcatggtagcacgtgcctgtggtcccagctactcaagaggctgaggtgggaggatcgcttgagcctggtgttcaaggctgcagtgatctgtgatggtgccactgcactccagcctgggcaatagagcgagataccatctaaaaaataaaaaaatttaaagtatggatttttgagccagatactcctcatttagttcaggtatgagctgttcctcttggtaactgtgtaaccttatctaactaattaacttctctcaacctcatttacaggtaagtttccttacctgtaaaatggcacacacacagaaaaaaactacctcataggaatattgtggggatttaaataggttatatgtaaacaacatatctgacgcactagtgtgaatattaaaatctttaaagaccatggaagcaataaggcgtgtgatcaaagcgctatccctcatcagaacatgggaagcaaataattttgctgctttcattgctgtttaagcttctttcgaacctagaaaaagaaaaaaggcatctcatttctttttggaaaactagcacattcctgacagcaaaactccacaaagatagtacaagaaagaaaagtacagactaaccctcttagaaatacagacataaactttccagataaaatattagtactcaaccttattggtatttacataggtatcaaattaatattgctttattatgtttctgattatgtagtgcaattgtttcctatttctgctataacgaactaccacaaacgtggtggcttaaaaacacacaaatttattatctcacaatttgggaggccagaaatctgaaattagttctaccggggaaaaaaaatcaaggtgtcagtagggatgcacttctgaagcctctaggggagagtgcatttccctgccttttccaatttctagaactgcattccttgccttttttagctgctactttccatctgtattccttggctcatggccccttttcttcatcttcaaagccaaaggcatcttcaaataactctctttactgaggtcatcacattgccttttctctctgtgttaaatctcactccctctgcttcccttgcataaggacacatgtgagtgcatttagggtccaagctaaataatctgagataatctacccatctcaagatcattaattcaatcacatttacaaatatgttttgccatgtaaagtaacatgacttattaggatatgaatatcttttgtgtgacatatttttcagcctaccatagtcttccctttaatccccaattattcatgtccatcccacatgaaaaatacattcattccatcccaacatccccaaagtttcaactccttacaacaacaattcaagtccaaaatctcttcaggtcaaaaatccaaagtctcatcctctaaatcagatgtgagtgggactctgggtataacccatactggggtaaaattcctctctatccatgcacttatgaaactggaaaacaggtcatctgtttccaaaatacaatggtgaaacaggcatagtacaatagttatagataatctcattccaaatgggagaaaaatggaaggaataaaggggtcactgattttaagaaattttaaaatctagcagtgcaaattccattagatttcaagcccctttgtggctcaagattctgctctctgagcctacagttctgccttctgcctctacttccacagctctaacctttaggctcaaggctctgccctgagttatctttcctttttcctgaaaggcaacacatgtttgcagctgagttgtcttattagcctcctccctgcctgtagaattttggaagcctgaccgctttcctttattttaccctctctctatccctttcagtacaagttggcagtgtttctgttggactaacatcctcaaaacccttgttgctcttccacatatttcacagggataaaaagccattagacaaaagtcttctccaagatagtcctggacaataccacttggattcctaccttctgttgagatgattgagtgggtccatgagtcataccttgaatctcttcagttctagcaaaaggttgtccaaccacatacttgactctctctccagggcacaatttcctaatagtgaatctcttaatattagtattttttttttgcaatgtgcataactgagtatttcccaaatcaagttctagttcctttttgcttaacagttctttccttaatttgtgtctttcctctaaagttttatataagcagtaaaaaaccaggcagtgccttcaacactttgcttggaaatctcctcagttaactagccaagttcatgcttacgagttctgctttctaccaagtgtagaaataattcagctaggctttctgccacgatgtaacaaggatctcctttcctccaatttccaacaacatgttcctcatttccctctgagcccttgccagtagcacctttaacatatttctaccaatattctatttatgatatgtgtatactacaagatgatgcaggcgtgctctacaccatgcttcttacttcctcttgagccctcactaacagtatttaacatccatatttcaactcacagcctgttcaaggcaatctcagtttttttctatcatgtgcctcaaattctaccagactctaaccattatccaattccaatgccactttcacattttaaaatatttgttacagcagcaccccacctctaggtaccaaattctggatcagtcagggatgcaccagagaaacaaccagtaaaacacatgcacgtgcacacatactcacacacacatttagtgcaaggaagtatcttatgtaattgtgggaactgactaggcgagtctgaaatccatagggcaggccatcaggaggggcagtctggaattcttgggcacaagctgaagctttagtccacaggtagaatttctttttctttagggaaacctcagttttccccttaaggccttttaactgattgaatcaggcccacccagactatcaagtataatctcttttacttaaaaagacaaatgattatagatatcaatcacatatacaaaacaccttcacagcaacacctagattagtggttaattggataactggggactatagcctagccaagttgacagataaaactgaccatcgcacagagcaaatagatggttaaaagtcagacaatccagaaatataaaataatgttataaaaactatcaggagacctaccatccagagatactactgctaacctctgtgaatatccttttggactttattctattcaaatacaaatacacacttgtactagtccattttcatactgctataaagaactgcctgagactgggtaatttataaaggaaagaggtttaattgacccaccgttcagcatggctgagaaggcgtcaggaagcttaccatcagggtggaaggtgaaggggaagcaaggtacctccttaacaaggcagcaggaagaagtgccaagcaagggaggaggagccccttataaaaccatcagatctcgtgagaactcactatcacaagaacagcatggaggaaactgccctccatgattcaattacctccacctagtctctcccttgacacatggggattatggggattacaattaaagatgagatttgaatggtggcacaaagcctaaccatatcattctgcccctggcccctcccaaatctcacgtccctttcacatttcaaaaccaatcatgccatcccaacagtcccctgaagtcttaattcattccagcattaacccaaaagtccaagtccaaagtctcatctgagacaaggcaagtcccttcctcctagtagcctgtaaaatcaaaagcaagttagttacttcctagatacaatgggggtacaggcattgggtaaatacacttgttccaaatgggagaaaccggccaaaacgaaggggctacaggccccatgcaggtccaaaatccagcacagcagtcaaatcttaaagctctgaaatgatctcctttgacttcatgtctcacatccaggtcacattgatgcaacactcactcatgcactaactcctatacacacactctcatacacacacttgaacaaactcacactcacatttaaaaatgatatagtattttgtaaataatctttgtaaaagaaaatatctatacattttttatttaaaaatacatgttcaactttcaaactcattttatgaggccagccagtttcctaataccaaagttagacaaggacaccacaagaaccgaaaattacaggccaatagctctgatgaacatagatgccaaaatcctcaacaaaatactagcaaaccaaattaaacaacacattaggaggatcacacaccatgatcattatccctggatgcaaggatggttcaacatatgcagataaataaatgcattagactacattgacagaatgaaggataaaaatgatatgatcatctcgataaatgcagaaaaagcatttgacaaaattcaacatgctttcatggtaaaaactctcaacaaattaggaataaaaggaatgtagctcaacataataaaggccatatgtggcaagcccacagctgccatcatactcaaggaaaaacagttaaaagcttttcctctaagatcaagaacaaggatgcccactctccccactttattcaatatagtactgaaggtcctaatcagagaaattaggcaagaaaaaaaatacatccaagttgaaaacgaagaagtaaatttgtctgtgtttgcagatgacatgatcttatatacagaaaccctaaagtctctaccaaacaaaatgttagaacaaatgaattcagtaaaactgtaggatacaaaaatcaatatacaaaagtcagtagcatttctacacaccaaccaacaatctgaaaaagaaatctagaaaagaatcccatttactatagtgtttaaaaaatacttaggaataaatttaaccaaagaagtgaaagacgtgcacactggaaacaaactgaggaaaaattgaagacaattcaaataaatagaaagatatctcatttcatggattggatgaattaatattgttaaaaatgtttataccacccaaagtgagctatagattaatgtaatttctagcaaaattcccatatcatttttcatagaaatagagaaatatcctaaaattcatataaaaccacaagagacctgaacagctaaagcatatatgagcaaaaacaaagctagaggcattacaccacctgatttcaagatacgctacaaagctgttgtaatcaaagagcatggtataggcataaaaaagacatgtagagcaatggaatggaatagacagccccaaaatccacacatttgcaaaggtgccaagaatacacaatagagaaaggatagtttatttaacatgtggtgttgggtaaactagatggccacctgcagaataaaattggaccctgatctcacaccatatacaaaaatcaactcaaaatggattaaagacttaagcataagaactaaaactgtaaaactactagaagaatacatagcggaaaagcttcttgataatggtctaagcaataatcttttggatatgactctaacagcacaggcaacaaaagcaaaaatagacaaatggaattgcaacaaactgaaaagcttctgcacagcaaaaaggaaacaataaagtgaacagacaaccaatggaatgggggaaatattggcaagccctacatctgataaggggttgatatccaaaatatataaggaactcagataactcaataacaataaaacgaataatctgattaaatgagcaaaggacctgaatagacattcacaaaagaagatggcaatggccaataggtaggtggaaaaatgctcaatatcactaaccatcagggaaatataaatataagccacaatgagatatctcacacctgttaggatgactgttatcaaaaagagaaaggataataagcattggtgaggatgtggagaaaagggaatgttgtatactgatgatgggaggtaaattgagatagccattatggaaaacagtatgaaggtgcctcaaaaaattaaaaacagaactactaattcaacaatccctcttctggatatatatccaaaggaaataaaatcattgtgttgaagatatatttgcattcccatgttcatcgcagcattattcacaatagccaagatgtggaatacacctaattgtccattgacagatgaatggataaagaagatgtggtatatatacacacagagtagaatacaacttagcctttaaaaaggaggatatcctgtcatttgggacaagctggatagatctggagaatattataagtgaaataagccagacacaaaaagacaagccttgcatgatctgacttatatatggaatctaaagaagttgaactcatagaagcagagtgaagaataatggttgccaggggatggggtgaggggtggcagagaaataaggagatattggtgaaaggtacaaagtttcagtcagacaggatgagttctgatatatattgtacagcatgatggctgtagttaatagaatgtattttatacttgaatattgctaagagagtagctcttaagtgttctcaccacaaaatatgtgaggtaatgaacatgttaattagcttgatttaatcactccacaatgtacacatatatcaaaacatcacattgtataccttaaatatactccatatttatttgtcaattatacctcaaaaactacggggaaggagggaggctgcggagaagaaacaaccctgccaacatcttgacctctgacttctagcctctagcttccagaattgtgagacaataaatttctgttgtttaagccacccagcctgtggtctttcattatggcagccctggcaagtgaatgcaggcaggtgcaatcctaaatcatttctttttttttttttttttttttttttggagacagagtcacaggagtctcactctgttgccccaggctggagtgcagtggcacaatctcggctcactgcaacctccatgccccaggttcaagtgattctcctgcctcagcctcccaagtagctgggattacaggcacttgccaccatgtccgggtgatttttgtatttttagtagagacggggtttcaccatgttggccaggctggtctcgaactcctgacctcaggtgatctgcccgcctcagcctcccaaagtactgggattacaggcatgagccaccacgcccagcccagcatcatttcttcaacatttttttcattctcttattttgcggagaaatatataagatttggttttttaatttaaacacatcaaaaccatgattgcggatgcatgtcttctctagtatgctgcagtagcatggggtggggggaggggaatttaatgctctgtctaaagatacagctcaccattatttacttctgaaaaaatgaagttgaatctaatcctgtcaacaatcaaccttacacaacccatgcactcagttggatcagacatcttctggggtttgtgttttgcaactatgctatcttgatgagccccagcaacagagtttttaacattattagatccaggacagcggcctttatggaaggagcagtcagccagcagcagctccctaacaatcccacaagctgagattctctctatccaggcagcgtggtagagaattctggtgggcccaaacgtttgctaataagagagcttggacagacttaaagttcttttagataaaaaatataaaataagacaaaaagaaacaaagaatacatgttcactatgcagcactcagagaggcagaagaaagtaaatgttattggaggccccaccactcagagagaaatcaccattaacattttggtgtatcttggaagtttgagatatatagataggaataaatataactgcagtagtaccccttcatctgcgctttcactttccacaatttcagttgcccgtgatcccagtctgaaaataggtaaatacaatgcaatatttttagagagaccacattcactttttgagagagaccacatgtaactttcattacagtataattgttctattattagtctcttactgtagctaatttataaattaaactttctcataggtatgtatgtacaagaataagcatagtatatatatatatgtatatatacacacacacacacacacacacatacatacatatggtttggtacaatccatggtttcgggtattcactgggggtcttggaatgtatcccttgaggataatggggactactgtacacaaatatatacatttagttgtaatactgtataaattttattataagggtgtaccttggatttatttatttagatgtaccataatttaaccaatctttttctgatgatccttgcattagtcagaactctttcttttgcaaatgacaaaaactcaccttaaaaccaacttaaaagaaacaaagaaatatattggctttaataactgggaggctcaggcacagctgaaacagggaatcaaaggatgtcagacttctgtctctccagcccatggtaggctctccccatatgctctgtgaaatggctaccagctgctctagactcattttctgtaggtttaataatctgtggcagagattgctattagcctacccagtatcctactggaaccccatttttatttaggaaatcagtgtgcccaggtaaaaactacatttctgagactcccttgcaggtaggatatccacatacaagacaataaagttctacctcacaccagatacacaaacattaagtctaagtgaaaaataggcctaaatgaaagagctaaaactatacaactctttgaagaaaacataaatctttgtgaccatgggttagacaaagccttcttagttatgatactaaaagcacaaatgacaaaaggaaaactagataaattggacttccaggttaaaactttgatgctccaaatgacattatgaagaaggtttaaagacaactacagaatgggagaaaatatttgcaaatcatatatctgagaagggcctagtattcagaatacatacacaaggaacttttacaagttaaaaagacaacccaattaaaaaatgggcagaggacttaaacatttctccacagaagatatgcatggccaataagcacatggaaagacgccgaacgtaattagtcatcaaggaaatacaaatcaaaacatgagctatcacttcaaacccactaagatggttaaaataaaaagacagtcaataggttgtgttggtgaggatgtggagaaattgaaacactcatagattgttgttgggattgtaaaatgatgcagctactttgaaaaacagttttgcagtttctcaaaatactagacatagagttaccatatgacccagcaattccacaactaggtatatgcccaagagaaatgaaaacatataaaagaaaaatttttaaagaactaaaaaaaatgaaaacatatgcccacgcacaaacttgtatccaaatgtttctagcagtgttattcataacagacaaaaaagtgaaaacaactgaaatgtccatcaaataatgaacagataaacaaaatgtggtataactgtaaaatggaatgaatgttattcagccataaacagaaacaaagcactgatacatggtacagcatggatgaactttgaaaacattacactaaatgaaagccagtcacaaaagaccaatatggtatggttctatttatattaaaggtccagaacaggcaaatatagagagatagaaagattagtggttgtctagggcagggggtggaatgggagatggagaataggaaatgacttctaatgagtcatggggatcaggcgcagtggctcatacctgtaatcccagcactctgggaggccgaggcagcgggcggtggggggaaatcatttgaggtcaggaattcaagaccagcctggccaagatggcgaaaccccctctctactaaaaatacaaaaattagccaggcgtggtggcgggcgcctataatcccagctacttgggaggctgaggcaggagaaccacttgaacccgggaggtggagcttgcagtgagccaagatcttgccactgcactccagcctcggtgacagagcgagactccatctcaaagaaaaaaaaaaaaaaagaaaaagaaaaagaaaagaagagtaatagggtttctttttggaatgatgaaagtgttctataattagatctcaggaagagttgtgcaactctgaatatactaaatttgtacaatgttaagtgtgtgaattacatgatgagttatatcttaacaaagctgctcaaaaaataaacctagcctcttattttatttaccttttgatctgaagacaatcttctattatttgataacttcatctgtacctgctcatgtatctacctctagaacttctgttgcatatggtaaatatatttccaagacctctcctccattcaaggccaacctggaagtcaccattcacatgtggtaaaaggtgttccagcaacccacccccgaccccactcctggccccagtggagttttgcaatcaccatggctctttctgagcccttcattgtttgccgtttctcacaatttctgtgtctctttcttaggggcttgggagaatcccttaggcctgtcttctaattgagtggttccaaaatctgagtaacccatcaaaatacttccaggcatttgttaacgctgtgggtccttagccaccacctgaggattccgattctacaagccacgggtagggcccagagactctttttaatacagtgctctggatgattggtgactttaattcagctagtttggcatttggaaacagcttttataactcactaattcctcgttctgtgatatccaccctgctatttcctgctctcttgagaattttatttcaacagtgtgtttcatctctaagaactctacgttgttctcagactgctctttttcataacagttttttttctgctttatcactgcaatgtcctctcaaatctcactgagaatactaatcagaggattttttaaaagttttttttgtctgtattattttcggtgtgtgctcggattactcacattctgagacttttcttccttggcctgtgctgtcagcgtggcagagcctccgtacacagggaggccacttggcaggatgaagactagcgctaaagtgaagctatcgcctcagcatggctggaaatttccatcaacaggcacccaacaagtacttatccgacatctcctaaggtagcggttttctaccttggctgtgtattaaaattatctgggaagctcttaaaacttccaaaacctgggcaaagcaacgaaaccaggtctcaggcatcagtacctgccaaaagcttcccaggtgatttcaatgtgtattcaaggtggcaaaccgctaatctaaatcaaccgttttcagaagttcatgtgatgtgaatcagttggggatcttagtaaaaagtagatcctgattcataacatgtgacatggagcttgagagtctgcatctctaacaagcttccacgtgatgccaatgctgccgccctcggttctgttctttgaatattaagggtctataacagtgggtctcaaagtgtgttgtctggaccagcagcagcaatgtcacgtgggtgcttgttagaaattcagttctccggactgatcccagaccttctgaatcagaaactcagggagtggggcccagcatctgtgttttaacttcccagtgatgtgaacgcttgctcaagtttgtagagcatacttctctaagcatgagcctctgagcccctgagccccttcaacaaaagccatgtggctttatagtgtgcacatttacggaccccttcctaggccaccccatcagactctcagaaggtgaagcggcagattgtgcatgtttaacaagtttcccaggtgacgctgatggatagcctaacatttaagaacggctgtctctggcagctcggccctgtgaggcctctgagaatgtttcagtgtcccaacattgaagcggttttggttatttggatgccccaggctatttctacccggttaattacctgtgtagaagcttaacacgattaattcaggtggataccatcttggatgtcccatagaaccctataattatgtgtgaaatacacatttaatttaagcacaaggggaaagattaccccgatgactctgaggccgtagggtatgcagagcagatgctgagcagagcttggagctgtttcctcatagacctatgccatagccatctgaggccagtagaatgttcaagatttgggctttcctgatccccaagttagtcttgatagtatctactgaagcgttaatgccactagtttacctaaactcagaaaaaaatatagttgactatttaggttaataaccagcagagataaaagtgtaattatttgggtaatttgaccacaaaatgtgcaaataaaatataatttttccccaaaatatgtgtttaaggtctgagttgtcaaaatctcattggtctcttcctttgacttgtgcagaaactgggtctgtaagtgtttgtttttgcagagaatacattttaatgtgctatgctatgacatattaaacgaatggagagactttggttcagaaattctttttttcctctgtactagccaagcatttcaaatgatttggctttggcttcagtgttcctttggagagctgatttttttgttgtttttttgttttgaggggtgggggttagcctcagccattaccaaatgaaaaaaatcaactccaaagtgcaaaaggaacagccaaaggaactccagaactgcccaccccacccctgggcagaaaaagtaaaatcacaacacaaaacagcgcaacaggccgttccctaacgaactgaaaacagttctttggggagtgtttcctgcccagggcctgctttccctgctggtttctgggctgccgctggaaaggggccaggcttcggcacctccttgcctttgattgctgtttatcccctgaaacatgattaggtataattacgtataatctctcccttgtttacccttctccaccgaagcttgaacgtggttcagttgtgtctttctctttgctgtgcctgagcacagcaaagaaacatttcccgtattttcaactttattatttttttaagaaatagaggcattaggtatccatttgtcccttcattctcccaagcctgacattctggcaatttctgaattgtttcatccaacaacgacagttgagtgccaagcatggtgctaagtgccttggaggagttagaagtgaaacctaaatagacccttctcccaaggatttcccatagtaagtgtctctttacatgggaaaagagtgtaattggaacataatgggaagaaataaagctactcatcttttcttcaccaacaacataccaattgtcaatattttctctcttgtagttatttgctagtttaattcttgaccctgaattaatcgttgatagctgagtttattagaggcaggggtccacgagtatcctatttggtttcttccactataggccatctctactgctctgttttcaagaaagttgagtattctacatgcaaagaagatccctaaaccagaattggcacatgaatacacgtatgcaatgatatgaatcgtgcacgtaggctctgggcacagtcgcacaagatcccatgctcagaaggaccctgtgcttggtttaatgtcctcctgtcaccaccttgacattcttaatacttttgaacaagggattctgcattttcattttgtactgggccccacaagttatgtagcgttttctgcatgtaccccagaacctattttttctgtggcattctcatccaactttgagcataaacgaatggaagttcatccagaatctgatggcatagagtgagaggggaaagagcagagtctgtgtgtgtgttcatgtgctgatgacttttgtggcactcctccagcctatgtttagatttctttaacatgcctattaatcttgtcaagtttcagcccagctcttctgaaatagaactgacccccaaaatctcctggcaatgggctgttcaggcctgtcccctttctcagagtatcctgctcactgaggggactgctaaaggaatatctgtctcccttagagggaaactgctacttcccagggattgagtttagaagacagaccaagagtgtgcagaagagtgaaaaatgacttcccccacacccttctaggttccttggctgggctatgatttaaattgacgtaagacagattaacaggaggagagccgcatttaattgtgtacacatgggagtcccacaaaatatgagactcaaagaagggtgagatgactgaagcctgtatagcagcctgagctacagaagggaataggggcttggggcttctgggggtggtggcgacacaagttatgggagggtgagagaggaattatacagtgaataaatgttgtcttgttaggcagataaaaagtctctcccttattaaaaagttgtctgggctgggcatggtggctcacgcctgtaatcccagcagtttggaaggccaaggtgggtggatcacttgaggccaggagtttgagagcagcctggccaacatggtgaaaccccatctctactaaaaatacaaaacttagttgggcatggtggtgcacacctgtaatcctagctactggggaggctgaggcacgataatcgcttgaacccaggaggcggaggttgcagtgagccgagattatgccactgcactccagcctgggcaaacagagtgagactgtctcaaacaaaacaaaacaaacaaacaaaccaacaaacaaaaaagttgtctggagcagttctcaggagaagagatgattgtctgtcttggcgtggtgtccagtctcctctcctgtgattggagttaatcttcccatgttgataagattcccagagagcagattcatgataattgagttttttttttggagtatccgtctttaggcagataaggggtctcagggaaaacctctgcctgcattcgctgttccccaagtgctctctgttcaaagtaatcagcacagcaaagtggcatattttggggtagcatttctggaactccttccttcaagtgtaactaacacttccagggggaatgtttgataagccatgtcccaagggaggggagatggaacctgtttgccaaaacaacagggaattacataaggggaagccagtgttcactctctaaaaccttaatttttagattctggaaggagagaggggaaggttacttcctgagctgtgaagaggttcagacccttctctaaaaagggttctgggagagaaagaggctcccaggcctgtctacacagcccagtggtgatgaagaaaaatgtattttcctttgacacacccctttgagtggtcttataaggtttgctttgtatttggtgaggcaaatattggcaaagaagttgatttggtttttgttttgtttttaagatgaaaagcaaaatcttaaaaaccagagctttaaaaagcctggaagaaaatatgccaaaatattataacacttgattttggatggtagacggatgagtggggtttttccctcttctttttacttcaggcttttcaaaaattttacagtcatatcttatcatttttataatataaaatgtaagtttatctaacatttaaaattaaaggtttagaattttaaaataaagatatgagcatgtatttaaacatgcttgggtcacctacctcagctgagagctttctcctgtcagtttctaacactaaaccttaatgaagaaggtaggaaatcagttgacttacacttctcactttgacatttttaaatcttaggggatatttgtatgcaaacaggaatgcgagctatggttggcagaatttatttctacctgcggaacattcccacctgaatctccagtattcctctgcaattttcagagcagagagaatcaaagccattaaaaagctgactgtgacatcaggctgaagagaggcacagatgtcctccccagaaacactacttgctcttacccaggcaacagaggcttgaggactaaccttgtaaattacctggcatgtgtaagtaacaatgtttgcaagaaagtctttcaacctttttttttttccccaagacagtactggtggctctttcaagttccaattataaatttccaaatcccagacacttgggtgccaggctgaaacagggactgctcgtgctaagacttgtagtaaattgcaacagtgtgggaagtgggcggtttgtttcccagagttcaagcagggactgtaactgccagtgccatctctttgagatgcttcgtgcccggggctcctagctcttccaggttgggaaatagctctcatacccggaagaggctggccagaggagtgaccagcaggagacagaactcaggcctgagggctctaggttcaccaatataaaagtaactgcttaatgtggcttccagctatgagaagaatataaatgaacaccgcgttcttccaaaggcctctaatctgagacacccagggatgatacatatgtatgtgttaaatttatctacaaagagtcaggacttgtggatgtccctttacggcttacaagccgaaatgtgtgcagcaatggaagttaacttcacagatattgtcttgtttcagacaaaaggtcactgggctgtcactgagagactcggtgaggaaaaaaagatggtgcaaaacgcctcaggatggcagcatcttgacttgggtaaacaccagtgtaccgcgtgtcttctgcatgcctatacacgtatgtctatacctcagtcagatgaagagcaccacaaaactggtatttaagtgattaagtgtatttgaaattttattgattctagaagaggcagcatatgaaaagagactgggcaagcagaaaggagtctgtaggctgcaaatgagagaaggatgtactgtctctgtgggtgactgggaagtgctgggcgtggagagaaatatttgaattagccaccacccaaatacgataagccagatgaaatacggctgctggctcgcctgaatgtggcaattccaaaggtgtggaggcaaatctcactgtacaaactgccccctcacaggttggcagcaagacccataattcagaaaaaaggagatgacgtcagaaagaccctcgcctccaaaatacagcctctcaggtcagagggaaggcacaaccttcttcctaacacatcagagggtttcctgaagcagtcagcgagagacacgtcggcactcgggaaaatgcagatgcctggacttctaatacctgggattccaggcaggaaaggacagcttggattttgatatagacggtaccacttgaactgggaatgaaccggtcctagagcaggtttcttaggagaaaaggctctaaaaacaaacaaaaaccctgagagaagatggtcatcctttcaagaggcatctacaagagttgtaacactaactagatgtgaggcctgggcaagggcacagagagatcatgactagcaggaaaaatgcaagataatgtgggacacaggaagctctggaggtccaagagcagttccgggaatgcttcaagtcttctcctgttggtggaagctggggctggggacaccaggagaacaaagagctatttggaaaagggtgacgacttctagaagcacctgttgctaaatctgaacttggaagttacagtacagaaagcacggactgtgacatcagagagatctgacttcattgcttcctaccttcccatgcttggcttagttaacccatttgagcctcagtttgtgaataataaaacctacttcacagggctattgggaggatttaacaacaaaatactgacaaatgggcactcaaaacatgttagctcctttctccttcattttattccctatttaacttttgattcatgtcttttactctttttgtccagttacgcttttcttcagtttcaactccctctattgtctttcaaacaatggtggaggctgaaggtatgtttcaaccccccttatccttggccatgcctccaagaactcagagctctgagacctacttcctcctcattgtcagataggttagacatgcagagggctcctaaacaccacagagctgacagtgaagccccatgttggctttgatctgaatctcccttctagaatagtcttgaggacctcatttctcttggggcaggccactcataactttaaattggattattgtcattcttgtgcccaataatgctcaattgtaaggttcttccaaaatctttaagaaatcgtcctgctcagcctccgatgctgacactcttggaccaaatacagctgaacttgttctgatttgcacagccgataactctgggatctgttcactgttttgaagataaaccaaaactaggtcaggctcttatccaaggctaaaatcagcacacgatgttgaggaaagcagtcaacaaacataaagacatttaagttctttgagttacttgtattagataatatgttctcatggttaaaaatattttaaaaatatataaaaagtgatagtgaaagttttctctcccatcccccatccatcttgttctctatttctttcccccaagacacaatccccattttactatttcacatttccctccacttttctttatgcccatgtaaatatatatttttattttctccccttctcacccaaaaggtaacaatccatataccttgttctgcatcttcgctttttctacttggtgatacacctatgtattttaacaaataaaatatacataaaatatatagagagatccttatgtaattttccttgcattttacaaatgcataatattccataatgtgtatttactggttcagtcagatcccaaatgatagacacttgggctgttttcaatctttgccaagataaacaatgcagcaatagcttaacttaggcatctgtcattttgtacctgtgtgggtagatctgtaggatgaattaccagaaataggctattgcggtagaaggtcaatgccttgtattttaatagatattatcaaattgctctccacagagctgcggcattgtggacgtcccccagcatatatgtataggggaaatgcctgttttcctgtagcctcaccaacagagtatgttgtcaaatgtttggatttttgccagtcagatatgtaaaaattgataccttaacatcatttcaaatggcgtcttattacattactcttattatgagttaggatgagatcttttcatatatttaaggatcatttgcattttttctctgaatagcccatgtcctttgccaattttctgttaagtcattggtctttatttgatcaatttttaggcctctttatataaagaaagatgaatcctttttctgatgagttctttttttctgtatttgtcgtttgtcttttgactttttatataaatttatttatcatagtttttatttgtgaacttttggggtttgagtcattagaaaggtttttcctactccaatgctacagcagttgctccattgttatatttgtccatgttttcgtctagcatttgtatgattttatgtttatattaaaacatatacttgatccatatggagtttgttctagtatacagtagtatacagtataaggtagggatccaaatttacctttttccagagggctgtacacttgtccaaatacatttacttataaatccatctttacctgcactgatttaagatataccctttatatgatacatattacactcatgtatttcagtctatttctggattgcctattctgcttcatacaaccctggagctatatcaaagggtgattaagaacataaggcttggaatcaagttacccagattattttattccaggtaatttgactccaaacatgccagcatggtagcatgcacctgcagtgccggctacttaggaggctaaggcaggaccaggctacttgagaccaggagtttgaggctattgtgcattatgatgacacctgtcaataaccactgcactccagcctgggcaacatagtgagacctcatctctaaaataatttttttttgagatggcatctcactctgtcgcccaggctaaagtgtagtggtgacatctcagctcactgcaacctccacctcccgggttcaagtgattctcctgcctcagcctcctgagtagctgggattacaggcatgtgccaccacacctggctaatttttgtattttagtagagatagggtttcaccgtgttggccaggctggtcttgaactcctgacctcaagtgatccccccggccttggcctcccaaagtgctgggattataggtgtgagccaccgcgcccggcctaaaacaaaatttttacaaaatcaaagcatgtgtgacctggaataatttatcagctttttcaacctgtaaaatgggattaaatgtgccttgcgttaagcctggcacagggacacactcaaacaatgtcaacaatgaggatcataatgttggtatgttttccagctgctggagggagtgcctcatccttgtccgtttatgtaggacctctgtaaggatgctgctgtttgtaccacaagtccgctccttgtgttcctgaagtagctgaagcatgactgtaccagcagggttccctaccatatgggagatgcccggtgatctctgcacattccaaacccctgtggaaatggttctgtcctccagtgcctctctgaagacctcaggcccaagtccttgggggaggggctgtggaataagttcccagactgacatcaggctctcccttcataagctctaacaaaagccttcccttctctttcatactaaaccttcatataaatcaactcctcattgtggatctgtccttcagctcatcagacattcctagacaggtttgaatctcatctgagacataggacaggtctctttcaatctctctctctcacacacacacacacacacaccactcttacacacacggataaacacatgcatattatcagagacctgtggatctaagaatgtgaaggaatgagtcctgagggattgaagagagaggccatttgcaattccaaaaagccctgcactctcagaatggaaatgtgagttagaaacccagtgtcactcaatgttcaggctttcaactgtctacccgtgttcaagatctctcattgtgcagaccacaagtaggttttgtggaggacagcaaaagaaagtgataccccagttttggttttttttttttccttttttgagacagagtttcactcttgtcatccaggctggagtgcaatggctcgatcttggctcactgcaacctctaccccccaggttcaagcgattctcctgcctcagcctcccaagtagctgggattacaggcatgtgccaccacactcggataacttttgtatttttagtagagatggagtttcaccatgtcggccaggctggtctcaaactcctaacctcaggtaatccgcctgcctcagactcccaaactgctgggattacaagtgcacaccaccacacctggccacgataccccagtttttacctcaaagggtttgcagtttaacatatgtgcaaaaactacacagacatacatcaagcaaaagagaagttagaccatgatatcctcaacacgttgggccacatttccttcagtaatggccacatgattggaaatccgtatgtgagctgagcacactgcttttcagttgatgataatgataaagtatacactaaacatacaaaaataccaaagtggtttaaagaatccccagttacatcaactttacatatagaagtgcatagttaaggtctcatgtgaatcactgatcaatttggaccaagtcaatgaaaacacagccatttaacagaccgagcatataaaatgcaggtaaacatttacttgtttcttaatccctctggctcatctcatgggctctccacaattttaaccactcagcaacttcaaggacacaacagagtcactgaaaattcagagtcccaataatccacattaagcatttgagggcaggataaaagttaaatgactttcctcttctcaggagtctcttgtggtggtttgttattcaatttgggtggaaatagccaccataacgacagcatctagtactagttaagtccttgctatgggccaaacacggtgccatgtgtttgacttgagtttttatttaataactaacagcagctgtctgaagaaagtactattattttttccattttggaatgaagaaattgaaaccttgataaatttaagtggctttccctaggtctcagagttaccaagtggcagagcttgaactcaggtctgtcaaagtccatactcataacctagagctaatcgcacttggccttcaattacaaggactaattggatcaagcctgggatcaggcctggaggcaccagacacagcagtaacaggggcaggtgattcgatcccactctgttccaattcatgtgggtgagcccattgctgaacagtctctttgcctaaaaatatcaggcagcccacaccctggagccctgcagctgcttatgcaatgccctagaactaggaagtgtttcataaaaccttcataaagactttttgaccaccgtgatgatgatggtagggagaggaaaggagggaaaatgaaagctagaaaggctaagaaagacaaccatagaagtggtgtaaaccagtcgtggacccacgatgtctggtcccctaactgaggtgccctgccaagttccagggtccctcttagagaggctcatccaggtcagcttggcaaaccacctttacctgtctcttacctcacggacccttcctggaacaaatgtgagttccgaggagcagctaagggtggctaagtcactgtcatagttgttcaatccattcaacaaacatctatttattgcctaccatatgctaggcactgttttagaatgtgagaataaagcaacaagcaaatcccaggtggaactcaagaaaattacactctacgagggaaggaggagcttcagggatttcagacaagcagtgataaagagtaatatagtaggtcagatggagataagggctatgtggaaaaatacagcaggttaaggggatggggagggagcaggaaaggagaatcagagaactgctgttttaatgaaggtgaccagggaaggtcttccttgaggaagtacctcctgtgcagaaacctgaaggaagtgagggagtgagccatgcttctttctgggcaagaatgttcccgccagtgggaacagctagggcagaggcccaaaggcaagggcatgcctaacttctttcctgagcagcgtggggatcagtgtgtctggaataaagtgagatggggaaagtggaggagataaagtgagtgaagtgagggaaggccagattatagagagccttgtgggccacaggaaggacttggcttctgttctgagtaaatggaaggctattgaaggactttgagcagaggagtggtacaatctgaagagatcaccctggctgttctagggaggccaggagagaccagttgtaaaggtattgcaataatccagatgaaagatgatggcgacattgcccagggtgggagctggagaggtgagacaaagtgatcagatttgggctgtgttttgaaggtagagctttcagaatttgatgaaggaatgggcttaatgtgtgaaagaatgcaaagagtcaaaaaatactccaaggtttttggcttgaacaatcagaaaaaaatggaattgccatttactgagattgggggagactccctgaggaacagatttggggacaaactaggaactgggttttgaaaatctaaggttgagatgcttattaggtatccaatgaagatgttcagtaggtagcttagcattcagtggagaagtctgggtcttgtgagaggcacccgtatcttctatccctggtttaggcaagaggtgttgagagtccgagctagggcaaatatgagatacattgcgatggtaaaataaaaagaatcagaagagctggatgagaaagaaaagggtgtttgggatgagcggaacatctttagtgtgcagaaattctatcgtaatgcgtactgcgaaagcgttatttccaggggctttgattgtatgtcgtgaatgtatcaggctatgctgacgcaaagaagagagttgcattcaatagcaaaaatgcaaatcaacaaaccagcaactcattttgaaattaattggcatgaaaatgcaatgtgaaaaaaattttaaattatttttatgtctttttcagtctagtaattgattctcttattgagtgttttatgttaagtgctttatgacatggagttttaaggatattgcataaaaataaaatggactatactaggcctcatacacataatccaaaccaactccatgtctcattgctttaaattaacttcagctattacaaattttttttctgtcttttgcagctctccattgattttttctttcatctcctctcagtgacctttattacagtctttcctgatgctagtccctcctactccatttcatcttttaaatttctccctgatgagataccttatcttgctggtcctatttcagatggagactgaattgtatagattccccagagagcctgcatcgaaccaaggaagtgactgatatttctacaataatatatctgagtttgtaaaaatgttcttccatcctattactgaaaattgctattaattaacttagcaaataattatttggcacattctttttcctaggcaccaccctaggccctggacatacaagtgtctgtccacaaggtcaatgtcacactttttatgctattggcatttgtaatgaaataaaaaaaattattcataccccaactcagatgtgtaaagataatgcaccttctttaggttgtccacaacagacacccccctgccccccacctaaaaagatgccagaaaataactcctaaattttagtctagtcttaaaacctggtgtggtgcaaccattaaacactctccttaagaaaatgctcaatccctttaggtaaaaatgcttgcctctctgatatcctctgcaagatggtggctaggtgtgtgaggacggggtgtggctcagtgaccttggctggaggaaagaaggcgttgtctgtgctcctatgtggctctctgagtcctcggtggcctatgtggcaatggcgtcttttgtgtgactcatctccatttgctctgtgagcctcctctgccattgtctgtggtctggtctctcagcctgatgaagccacagtggtgcccctcaactcctgtgggcatcacagacccctctgagctctgcctgtcttccattcactgcctggaccagtctaactctttgcccctcaccatcacaggcccattacatgcccatcagctctcaactcagctgcttcctaaacacccacccactcaggggcatgtggggtcttctgggccctacccatgccacatcaataccaacagctactcaggagaaccaattctagttctcctttggcaaatcgtgctgccccaccaagctactctgatgtggccccacaggcgagggcagcacagcctttgagatgagctccttccagagtcccagatgtgaagcaaacatccgcctcacgctagtattccccataacctgtctaacattcctccctacccctgagctgaggcctcaaggaagagttctgggcacactatcatattctcctgccttcctctctgtattagtcagggttctccagagagacagaactaataggataggtagatagatatggatatatgagacgagatttattagaggacttggcacacacaattatggaggctgagaggtcccacaatatgctgtctgcaagctagagaaccataaggatgtcttagtccaagttggaaggcccaagagccaaagaggccgattgatataactctcaatctgagaccaaaggcctgagagccctgggaggacaggtgcaagtcccagagtccaaagttctaaagaacctgaaattctgatgcccaagggcaggagaagaagggcatcctactccagaattgagagggggtggggaaggaggagaggaggagaaggggagagggtgaggggtacggtggatgaaataggggagagagaactattcgcccttcttctgccttttgttctatctgggcccccagcagattgattagtgcctgcccacattgagggtggatgctccccactcagtccaccaacttgcactccaatttccttcagcaacaccttcacagacctgacacccagaaataatgcttcagcagccattgaggcatctctccatccagtcaagtcggcacataaaattaattatcgtactctcccttctttttactaatagtcgcctagtccagaagatgaagtgtttcttttgcatccctttccttctgcccaggatttactgtaagtaacctgggctggaagaggtgggtgttgagctgttcccttcctctgtccacttcctccctccttgtttactcagcctcatggctaagcctgaacagcacatgtggagggccagagaaggacagagagggttaacaataaattaacctcagttgagaggtattttgaaaatactgttatacgttgaaggagaactattttttttttttttagctatcaaaagatagggaaaaataaaaaaacctcagctctcaaattctggagcaaagagtaagccttttgaggagataccttgtgattctgatgactccgtgatacacgtttctactgcagtatggtctgactggatgtaaaagtagcacagagatttgaatattataatatttcagttataaatcccatacacgaagaggaaactggaagagaaatcttagaaggaacattaggggtcctctaattatttgttccctccaaataggaaccctgatttgtatctctgtatccctctgacttcctacataagctaagtactatactaaggaaataaaacgactcagcaggcatcctctcatagctgaacaacctccgttgtgagaaaatctctccttacattgagtcaaatcctctccctcccgcttccagatgttgtttctggtcctgccccctggagctatagaagcaaactgtaacttctttctccaatttaatatcttacaatattctgcctcttcctcaatctcttcttctccaattcatggtgtatgtgtgtttctttctttttaatttctgccacctggatactccttcccaggaacattccattctctcttgtagtgcttctcttaaaatgaggtgcctgtgggtgtggtagcttgagcctgtagccccagctactccggagggtaagccgagagggatgggggaggctgcagtgagctgtgattgtgccactatactctagccagggcgacagagcaagaccctgtctgaaaaagaaaaataaaagaggtgtctggatatgagcaccatgccccagctgtggtcccctagcactgagtctagcaggatctggatcacagacttcttatgccggagtctattaacagagattaataaatgtttgctccacactctattcccaagaccgcgtggttctctgaaacttccagcttgagcctttagctacacctgccaagaaaatattggatatggatgctgtcatgcaatccacttcctttctccctacatatccctgcctcagctgatggaactcagacgccggacttgcccaggctcgtacggttagtagaggcagagttataaaaacaagtgctaaaataacaaagcatagagctactgcactccatagtaaagaaacaatagttcaaaaagaaaaaaagcccaggaaaaaaacaagattttgtttagtccttttgttttctctttgttgtctcaatatcttacccgatcccccaaccccaccccagcttttaaacatccttcacatgtgtaggcactattcaagagtcctttaaaaagtagttaccaatgttctactagaagaagcatacaatcacaatactatactttctcaaaatgagacaccattatggttagcatgaatcattttgaaatggatggatttgttccctcccccaactggtaaactattaggttactcacccttcgtatgcacatctgtaaatacttaattcaactctaatgaaatattaacctatgactattgcattaatacatgtataataggaagtatcttagattactactttgcctcaagtaaagtgaatgcaaaaatggtgatataatattcccccaagaactgcaaattttgcatttcctgacatggggtaggttttaagttacatcatatactttgaaaaaaatatagagatatggcttctgggttagcatggcagcagaaggctgttcttgatacagttcctcctgccttcccattaaaatgccatgaggatagaccaaaatacaaaactgatgacagcactggaaactataaataagacagtgctgtcggcctgcagtggggcagaccaagaagaaggaagaggaagcatgctgtttaatttgcctcctgcatgctctaccttttgaaggagaacctggcagatggccctagagaaggaaggcattacttagattcttccttcggcatctatacataattcaggtgcggacccgacactctagaaaaacaaatggcaatttcctaactgtgcaggagtcatgttctgcatgggctgggctcagccctctatcactgcatcagcatcgcgtcacacttatctggagattgttaactcccagcatgccatggaacaggaagcagcaggaaagagaagcccccgcatcctgcataaggagtcccctctcccttgagagcagggtggaaagaagtgtgctggaggtgtgtggccttcacgtcagacactgtttaaaggaaactgcccgctgcatctgattttcttggttagaaaatgtacaggctggaatgggttgcaggttgagtggaatgcatttctggggcttgcagagatacaacaaatgtctgcgaggggctcctttatcagccccatctttgggagttgaaagggccaagaaaatgccacataccttgtctgttggcaaaccctgagtctggatctatttacttcattcatagatgactaaacatgttttaaaagtgaggtttatgaaaggtttatgttcttgccattaataaacagtggatcacctgaggtcaggagctcgagaccagcctggccaacatggtgaaaatccgtctctactaaaaatacaaaaattagccggtcgtggtggcaggcgcctataatcccagctactcaggaggctgaggcagggagaattacttgaacccgggaggtggaggttgcagtgagccgagatcgtgccactgtaccccagcctgggcaacagagtgagactccatctcaaaaagaagagaaacaaagtttaaggataattttctaagcctaaagacactagtagagtaactgaaaatagaatttctgaattccaaattactgcagaaaattcaagcaaataaaacattattttaacacagcacagaatatagagtgaaatatagaaaacaagggaaacagacaatacaaaaagaagaaaacataaaatgagtcaataaagacaacctctttcataaaagacataaataattttttttttttgaggcgtagtcactctgtcacccaagctggagtgcaatggcgtgatctcggctcactgcagcttctgcctccggggttcaagtgattctcctgccttagcctccagggtagctgggattacaggcgtgcaccaccacacccggctgatttttgtatttttagtagagatggattttgtatttttagtagagatagatgttggccaggctggtcttgaactcctgccctcaagtggtccacccacctcggcctcccaaaaagctgggattacaggcgtgagccaccgtgcctggctgacaaataaacttatacacttaatttctgtggagaaaacaaaaaatttacttaggatgtgtgagaaaacacttgcctaattgggaaccatactgtcttggtgatgagagaaactttttattattatttatttatttggagatggagtcttgctaagagatattaaaacattttataaagctatagaaattaaaacagaggccagacatggtggctcatgcctgtaatcccagcacttcgagaggccgaggcagaaatcacttgagctcagaagttcaaaaccagcctgggcaacatggcaaaactccgtctctacaaaaaatacaaacattacctgggtgtggtgggtaaacagcattgtactggcataacgaaagacacatcagtggaatagaattcaaattaatggacatcagatgatagtcaataaatgatgttgagaaaacttgctggctccctctccccttccctccctccctcacctcccttctcctctcctctccgagacagagtctccctctgttgcccaggctggagtgcagtgcagtggcactgcaagctctgcctcccaggttcaagtgattctcctgcctcagcctccagagagctgggattacaggtgcccgccatcatgcctggcttgatggcgattttcacgggaaaaaaaggctagacccatattgtacttgtcggtgttaaattcctgagagattacaaattaagaatgcaaaaacttgaagaaaagatgaggaagttctttttgaagcttgccaccaaagacaaaaaccataaataaaagactgctagggtagattactaaaattaaaaatttttgaaaagggaaagcactccataatcaaaattaaaaggcaaatatgtgtttacaacacatatgacaaggaactaatatccttaatatataaagagttctacgaattgataaggaaagattagcacccaaatatgaatattggcaaaggacattaacagacaattcccaagagaatataaatgaccaatagttatacaaaaatatgtttagccttactagtattcagatatacaaaatgaataatcaggctgggcaccgtggctcatgcctgtaatcccagtactttggtaggtggaggcgcaaggatcacttcaggccaggagtacaagaccagcctgggcaacatagcaagacctggtttctacaaaaataaactctcaaagctgagacaggaggatcttttgagtccaggagtttgaggttacagtgagctatgatcacgccactgaacttcaagagtgggagacagagcaagaccctgtctctaaaaaagtaaaaataaaaaataaatcaaaaaaatcaaataaccagtggagagtatttattatgttggcaaagcctagaaagccttctcagtggtgtcaaagatgagtggaaatcaaatgtagctatctgctggacaaggcaccacgccacctctagcactagacagctcttccgacactaatgttcctggaagctgaatgctctttcaactgaaggagcttataggcaaggaaaaagcaggaaggtcacaggagtagctgcaatgtagccccattattgttgaagggcagatttcacgggagtcattaaatgagcaagctggaaaaataagaggctgtggttggatagcaggatgttgaaattagtagcatggacaatggcatcttttctgaaaaacaacaggttccgagttgaaagggtgggagaagatggctggggtggtttgcgaggcaaggcctttgacaacgaggaagtcagcgaccaagagtctgagatttttggatggctgttaaggtggactgtgaagtcccccaggatgatagcatgcattggatagtgatggaggctgtgagtcaggtgcaaatgtcaccagtgaatgcaaggaagatactaggagggctgtaaaggggagcatcgaggtgaggagagagtgatggagcttaaaaaggggctttttttttttttttttgagatggagtctctctctgtcgcccaggctgaagtgcagtggcgtgatctcggctcaccgtaagctctgcctcccgggttcacgccattctcctgcctcaacctcccgagtagctgggactacaggtgcctgccaccacgcctggctaattttttttgtatttttagtagagacggggtttcgctgtgttagccaggatggtctcgatctcctgaccttgtgatctgcccgcctcggcctcccaaagtgctgggattacaggcgtgagccaccacgcccagccaaaaaggggctttttattttcacaacagagtaaggagataatggtctagaagtggtattttggagcaaggaggacaagatgccaatttctgagcctgaaatccatgaagcatacaaaaatgagcagcctctgttaagggggtcagcagaggaagtgatgtccttggtaccagttaagactgacgataggggaagtgttccatgaaaatgtggaagatagagaggtatttagtaattatggaatgagaactctgaagtaaaagagaagagggttgagaggaagaggagaaaagtacagttcaagtaagagagaggatgtactgagctgtacagtgatgaaggtcaggcagatatccaaggaaggaatcacaaggcatcttaccccaagaccaaagatttcgtcagtggagatggtgagtgagggtgcagtgtggagtctatcacctgggtttatctcccatctcaacgcaccatggactcagctttggagaggaatgggtataaacaatgaaagaggagtgtcacagtgtgatgagtatactttgctttacaagtagcagcactccaaattaaattagcttgagcaaacttgactcatttctacaaaccataggcagggcagggtaaactgggcctgaaatcaggtctgtacttctctctgcaagctggcttccttgtctcaaaccagttctagaaatttagtacccagcaactcccaagtttacatctactagatttaccactctagagattagagctccttgagttcaaacattccagggaagagccctgactggctcagtttaagtcaattacccatttctagccagtaaggaagactaaaacatggcaacagtgtaagctgcaaagatagttattccccccactttgcaatagaacaaggggactctattttttgaaatggagtctcgctcttgttgcccaggctggagtgcagtggcacaatcttggctcactgcaacctctgtctcccaggttcaagggattctcctgcctcaacctcctgagtagctgggattacaggtatgtaccaccacgcctggcttgttttgtatttttactagagacggggtttcaccatgttggtcaggctggctagtctcgaactcctgatcttgggtgatccacccgccttggcctcccaaagtactgggattacaggcatgagccaccacacctggcctgaacagggagactcttgtgcaccagcagcagctgccagaggaggcagtagcagcgtctaactaagctgcagtgccttgtggacatgagtcctccctatggaaggagatctgacaaagggaaagaaaaaatatcctcatacagtggacctaacttactcagaatgcatgagacacactctgggtgatcccagaaatgctcgctaattggaggggaactttgcagttgggtgctgtgattgcagtcgggggaaactagtgaaatccaaggtcccatcatcaaagtgacctcctatataattacaagctggaatgacattagggaacctaggctacagagaaagaaatgaattaacaagggaatggctaacatgcttcttacaatgaaaaagccaatgtgaaggtaaataaggaatactttcgctttcacaaaacactcacttggcctttcttaaacaatgtttttcagatccaggccttacctttcatagatctaaaggagtgcctgaaagctgccaatttatttaagagaaaggcctaccagagatatgagctgtgcattctgaatccttcaaaagattgtccttttacctaaataagaaacacctctcatatttcactgaatctaaaactctatcacttgtaagacacatcatgttatattgttaggctataataaaggctgacaattaaactctaatatcatgctgttttatcacttagagtttgtatagttatttaaagaacactttaagattatttagagacagatttttatcatgaattactcttatgtgtacctaaaagaaagaaaatataagcaaaataaattggttgcagtattcttaaacttcatgttcaaatttggctcttctaaattagtttttgaattagcattgttgaaaactgctcctttccctccttacacacacacacacacacacacacacacacacacactaccatctttgaggatgtgacattttttaaaatgagttcttcattaatatctcctggatttttttcccagccactgatcactcttctgcaagttttgttgcacatgtgcaaacagtgacagccccatcatcaactgcaacctagccaacaggtttaagacacatcccgatttcagatgttaaaatgtgaccagaaaaaaagagtgttttagaaccaataagcacagcattcatgagttataacaagaagtgccacgtgaatgccaagggcagaattcctactgacacttaagattcaagacaatgcagtggtaacatcattttagtaggaacagtcttctccaacatactgttgccaagtctgtgacttctttacaggtaggcgttttctgatgagaccaaccctagtggtaatgctgggatggttacctttgaaagaggcttacgtggcttaaatcagaaagacaaatcatgctttacataccttgctattttttgcttaatgatatgttttccagacctttccatgtaagcacttgtaatgaattcattctttgtaatatctacataacatcccattgtatggatgagccatgattaatttactagttcattactgatgaacttttttcatacactttgaacatacactttactggcttccagcctttttgttattgcaaataaggctgtagtgggcatctttgcctctggaaatatgaggaaccattaatagaggttgcctttcaagagtgggcccagaggcttgggataagaagacttccttttcattgtatactctattgactgtattgatttgtgctctatgcctttattattttacagtttggaaaactgatctttttcaaagtgtttcctggtttggttttgtttggttgttgtttttgccttggttttaggatgaatgttaggcttaggcctctttactgacactgctctaagctgcgagcctctggttccttgtttggtttttttgctttgttagactttagcaaaagacaattggcctctacaaacccagtcaagttctctcttcccaccccaagctagaaagaaatacttaagaaaccctctaggccaactttgtccaacccacggcccacaagccacatgcagccctgaacagctttcaatgtggcccaacacaaattcataaactttgttaaaatgttatgagattttcctgtaatttttttttagcatattagctattgttagtgttcgtgtgttttatgtgtggtccagtacaattcttcgtcttccaatgtggcctagggaagccaaaagattggatacccctgctctaggccatctgcattatcaaatgctacattttttctgcatttccagacaggagtaggggtatctctagcctgcaataccctgtaggaattctgcattatgtttcataaaggagtccatatcctctcttcccttttccttttagtcctgaaaactggcattcacatttcacaatgccctgaaagttccctctctatggccttaattcagaagtaatctccagttcttaataaggcctgttgtaatggacatcttgtaattcgatatccttgctaacaatgaagctgtattacacagtggttaaataaattgttcttctgtgggtaagtgtttttaaagcattttttttaataaaaggatctcatcaatttcaaaattccatgattttgaaaagttttatttagattagcattctactctttgattctcttgttgatacccttgtttgacagtacttgactttgtttcatcccaggaatattgaacttccagagtttgtgttgtgatttttaaaaaaattcacatttcataaataaatagggagaagagacaaatcttctcaagtaatatgtgtagatatcttagtctttcacctccagccacccagcatgagctgtagctagtgactcacttccaaaagtaaagtatgaaaagggaaacatggtaactttacagtggagaaatctggcaaacacccccccttaaccaaatgatcaaagctaacatcatcagtggtgccatgtggctgtcagttacccccggatgtgatatcagaagggaacatgacttcaatgtattcttctacccccaaaaaatccctaacccctcccaagagggagggagtgtgttcccagaagaccactgtatctggtcttcctataatgagaaaatacatcagacaaacccaaatggatagacagtctacaaaatacctgaccagtgttcttcaaaaatgttcagggaatgaaagtcagagaaagactcacaaactgcagcagattagaacagacaaaggagacacagcgactaaatgccatgtgggacccaaaattggatcctggagcagaaacaggacattagttgagaaactggtgagatctgaatagcattagtcatgtacccatgttggttttataatttgacaaaggtgccttggtaatgtgagataacacgggacacacactggatgaaggggtatacagaattatctgtaccatcttggcggctcttctgtaaatctaaaaggattccaaaataaaacaagcttatttaaaaaatttacatttgcattttctcttttcaagattgtgaaccaatgaagttaggactttgtttagcctgattttctttatctagagctttacatatgatgaaaaacctgctgtcgctgctgcaaaacagagttctcccttctcccctcagtctgacaaccagaaaacaaaaaggcaagaggccagcaccaacagtcagagcaagagggagggagtgtgttcccagaagaccactgtatctgcgctccctggctactagggtgccaccatagtcacagctgctgtttttgaaggtagtgatgaaaggggtcactccaagacctcaagctgctgccatctctctcaatagcacggactgctggtaactgcaccatgatgagcaagattcataccaatgggctgggggaaatccccaaacgctggtgggacctcgaccccagccagggtccaggctcttcacactgtcatgagaattaatttaaggataagttgcaaaatagtgaaagcacagagatttattgcaaagagaaaagtacatactcaagaaaagggagtgcaggtatactcaagagagagttgagcacaagggggtttgggcctgctacatttatgggtttctttaaacaaggggtggaatattcatgaaaattcctggaaaaaagtggagatttctcagaactgtggtgccacccatttttacaccaaatatgggtgttcttggaactgtcatggtgctggtgggtgtgtgatttgtatgttgataagcatataatgaggtcctaagtgaaacctaggtcaaatccagtgccatgttgtatccagttggtcttagccagcttggtccacaccctgtttttcagggccttaccagctcataccttctgcagttatttcaccagtttccttttgctggtcattccagctgaaattgctgcctggaattttttattctcctgcaactgccctgtcttaagatggcagcaacatcttccacaactgcatttttagatcctgttgtttttagcagaatttcttggaacaatcatacgagttatgtgaataatattaaaatgataaagatgctgtaaaccacggagaatcaataacttctttcaaaggattccaatccacaaggagagagggaaacaaaaagatttttatcactgagccaaattttctgacccacagttcaaagacgtacctccatctccagctaaggcagactgtgcagaatttttgagtcggtggaaagattttgcttctcttccctccatccttcaggaccataatcaaatgttaaagccctaaccctccatgtgactatattaaagatggagactttgcagaggtggtgcagaggtggttcaggttaagccctctctccaccatgtaaagacacagagagaaggcaactgtctacaggccaggaagagaggccgcaccagaaacagacccggctggaccttgatctgggacttttagactccacaactgtgagaaatacatttccattgtttaagccagtctatggtcatttgttatggtgacccaagcagaccaagacagcttttctcccttctgcttttccttttatcacaagaagggaagaatattacaggcaaaattctgaacaaagctgtcatcaacaaagagcctccatcaattttaatcccaaagtggctgctgtgtaagcaacaaggagagtgatagggcaggagagagaaagagatacatcacctttcctaggtgacactcaactccctgtcacaaaggcaaagctcagctggtcagaacttaaaattaccaatgacgatgatgatggaaaaaattggtgtttagagtttctttcccctttttaagacactactaatggaacgacctggagtttcttcttgagtcctttaaatgcatctggaagtgaactcacaaaatttccccatgcttttccccactgtagaggtctctcaaggctcttgttgggaatcgcatgaggtaatggatgcaaaagtgttttgtaaaatacaaagcattccatgcatgccagctattattggaaggaagcagaaggatgaatttaaatcccaagatcccctgaaaaatgtgtgaaaggtgcccccatttggattgtcatctttaccgtacatttacagaccatttagcaatttctccaagtgcttactcccgttccctcggtgacatccttgccctgtgctggggagggcagagaaaggctgactctcccaagcctggcccagtggacagcagcagggcctgcggaggaaggggcttggttgctaggagaccagcaaaagtgggcagccagttcccaagcaggttagaatccggcgaggaaggattttaaaagcctatttccgtctgcttctgctagaattgaaattctcttcagggtccagccaccagtgatacaatctgcttacattactggtattgagaggcccttgaaagggatctatctggccatttcttgtgtctccctcccacagtgcctagaaaaggcaggcacttaaaacaaaatgaaacaaaaaaaaaaaaaaaaaagaggagttgatggagtctgtagcagaagcagagaagtgacagcaagaattaacccaagcacatctgatcatgacccttagacccccaaagaggaaataattgtgctcaatctatgttaaattacagtgcaccttccatagcttctgagtacatcaaggcaggtggctggatagaactgaaagtattttttcaagccctcaagaggtgtgtcaagcgggtcttttcctctggagtttatcttcacagacgcaacctgacatgtgcttctgggctaattggatgaggtcgacactgcatttaagttttccctttgaggattatgaaaatgtgattttcaaataagaattatttgtttggttttgttttcccaaagcatgcagtacacccaagaaatcaaatgctttttcgaaccccctgagccctcagcaagatatactgacacttacaactgcctagaacacagtattgaactcaggaggaatcagctggaaaaacagtggaataataggtgcatttagagtcatttatgggctgaggcttgacagtcttcatgccttgttactgctgcagcattgagagcaaagcggcggtgctgattcatcaggaagaaagaagctcgcaggtcataggaaaataaactatctcggaagaggctccagtgtcctcagcagacatgctttatttggttaaagcataatgtgtaatggcaaaatggaagaacaatttcagtatttacagggaaaccctggcttctagcctgcttttataggcagttggaggtgggggtggggggactccaaggggatgcagtaattggttgagaaaagaacaattcaggaaaatagaggacacacataggctagtgcctgtctcatgaagatgaagatgaaggcagacctgaaaacacagaaaaatgtgtcttgagaaaaactaaaaccccttcattggcaaatggtagggcgtgtgaggaccacaatggtgagctgatgcagggaattgcagcaaggtggggagatgaaagaccatgatcctgtgcatgcaaatgagaaataactgaatgtcacatatgcctctgcatctaattcactgagtgaaatgggcaagctctaaagctgtttccccctaataagtgctttgcacatggtgactattttggtgagtggaacgatcgtgaactttggggtcacacagacctgggtttaaatcctggctctgccagggaccttgggcagtgtcggagaagacatttaattttctgagtctccgttttctcatctgtaacacaaggtggtaatgatgcctgtgatggcttcctccagtgcagaagttctgtgaaacagcccagccccacctgccttcttaccctctgtgttcccactctagattcagatacctgggagtgagggtggtctgagtggggactgtgattgaaggggtagggccccattattcatagcttttcctggaatcacagattgtgaggaagtggcatttctccaaaaggagagatgcctggcagacaaaaacatgatccaaacaaaacagcttgaaaggaatttttgaaccttaaattgaacacgaggcaaaactactgcttcagaagtttgtgataaagtggtggtagctttgcaatttcaaagaagcatcactttgggatttggattaccctggcagtatcgtccgcatctcctaagaggagaaccagggacttgtcatcagatggtttctcatagccagggccacctacatatttaaatatccccactgcccctgggttccaaagggcaaacttaatgccatttgccaggcattggaacccatagggtcaagattccctgaaagaccccttctcctccttcctgtatgaatgaatgtgattctgtaggcctggttcctcacctcaaagattcagctttggaaacagcagataagtaagtaaaagcaggtaccagctctcaacaaatgctgcattcaggcctggttagcaggtggggcctccgctcatttgttttttcattttggataaatttttggggggtcttttcccctttcaaacaacaccaggaccccagcaggagcagttgaggttaggcaggaaggcaccaggggctagggctggggtaagactctcaatgagaaccaaagaaggggcagctccctggctttctgctccctggtggggcggtctgtatgattgctggtcatctgagcaccaggagaggagcagcccaagaggtcccccaggagagaaggcatctgctggcccaggtgcaggttattatggcagcagtccaagtctttctgcctccagcctctcaagctagacataacctggccatctgaccagcagccagaggtgcttctgggaagagtctcatttgttggtccctctcccctttcccagcatggatcttactaacccccaacaggtgaacaggtgccaggcctggaaagggcctagttgaggttgggtggggaagatgcagtcctgctttcacatcccagaggctgagacctgggcaggtggggagaaaaggagcaccagctctgcttccagcaactggcagccacgtggattctctgcttgtactgcaggaatccaggaacacccgccacacctgaagcacccttttaaggaaagtggcccaaaccagttctttcttgcgtcagttgctattgcttatgctatgttttgagcgaaaccaacttggtgccctcaccataactggcttcaccagacatggatgccaagccaaaggcagccacctaggaactggacatgacaactgcatctgagacagtgtagcataaaatctgccccataagggcccttcatatcagaaggtagcaaatccacccattatggagtgaattgtgacccctctgtatttatatgtgaagcctccagtatctcagaatatgactataattggagctggggcctttaaaggggtgattacattaaaaatgaggccattactgggcacgttggctcacgcctgtaatcccagcactttgggaggccgaggtaggcagatcacctgaggtcaggagttcgagaccagcctgaccaatatgatgaaaccccatctctactaaaaatagaaaaattagccaggagtggtggcgggcgcctgtaatcccagctactcaggaggctgagacaggagaatcgctcgaacccaggaggcagaggttgcagtgagccaagattgcaccattgcactccagcccaggcaacaagagtgaaactctgtctcaaaaaaaaaaaaaaaaaaatgaggccattggattggaccctaatccaatctgactagtgtccttataaaagagaacatttggatgcacacaggagacaccaggggtgtgtgcacacataggaaatgctatatgaggaaatgccatgaaagaaggtaagccaaggagggaggcttcagaagaaaccacacctgcagacaccttgatcttggacttcttgcctccagaactgtaagaagataaatttctgttgtttaaaccacctagtctgtggtattttgttatgataaccctagcagactaatatacatccaatttatttctctttttaggggagttaaggacgaggttaggatcactcatagtctccttggaaggactggaatctaggcagagtccaactgaggagataatgtcccatatgaccctgtactcttaactatcctggaaatccatcctcatcccgagagagcctcatcaccttttgctcaaaaccttatggagccaggttaatacacaggaagctcctgaggagcaagaccaagaatgtaggccttgggtgtgcacctgggctgtgctgggtcaggtagaagccaagagaactaaacggttttgtcacccagagtctgggtgacaaaatctcaggccctggtggggaagatgaggcactttaggagacagaaacaagagaaagtaaaagaataaaaacgtgtatttgtgtttatgagaaacatcaaatattaatggggctctaactagacttacagactaggagcaagcaatcatgtcaagtggcagggtccatggagagtggatgccatcctgggggtgggggaggctggggccctggaagtatccctcgggtgtaattcctgtattggtgtgaggtgaatagttcctggtgaggacaaggcttgccccagtgatgttgtagattctaattcttttttttttttttttttttttttttgagaaagggacttgctctgttgcccaggctggagtgcagtggtgcattctgctgactgcaacctctgccccctgggctgaaatgatcctcccacctcagcctccagagtagctaggactacaggcatgcaccaccacgcccggctagtttttgtatttttagtagagacggggttttgccatgttgctcaggctggtcgtgaattcctgggctcaagtgatcctcccatctcagcctcccaaagtgctgagattataggcatgagccactgtgcccaccccagattccaattcttaaagctgaatattacctaatgacttcctttttgttcttcttgataaaagtaaaattagatttctttttccataattggctcgcaaaatgattaagccaggtatttaggcagactgttattccctctttcctgcagttgttgataagcatattttaaaagtgtttgaggaaaatattgatattttgtttctccacaaaggttatgttactgtcactctggatttttctggagagatgggaatccagggaaaggagataaacttgagccaccctttcaaataagtcctggcaactgtgtaaagaagttaaaagtgtggcaggtggtcaggcagggcacagaagaggctccttgtgttctcacgctccaacacgtggtctgcagtattgctttcttctctttgatttgatttgatgtgacttgatttgatggtcttgccttgctcagctgagaagacgccagcatgagaaaggaggggggtgtgggagaggcacactgtcctgaaagcagtgggatccaggggaccggctctattgctcagtggggagtttgtcctttcccttcttgcattgcttgagggcttggccagggctttggggaggagggggacaaagggtaagagtgaagctggtttgcaatgggctgtgagagtcctagctctagtagcagcccagcagaagcatagaaaccttgccaacagccagatttatctatttacttatttattttttgagatggggtctctctctgtcacccaggctggagtgcagtagtgctatcacagctcactgtagcctcaacctccctggctaaaacaatcctcccacctcagcctcccgagtagctggaactacaggtgtgtgccaccacacctagagaatttttgttttttttttgtagagatggggttttgccatgttgcccaggctggtcgcaaactcctgagctcaagcaagcctcttgcctcggcctcgcaaagtactgggatagcaggtgtgagccactgtgcccagcccgctagatttatttttgttctgccctcccagaaaactaggatccttagaactcaccagtggtcctgcagacaagaggtattagtatgggctcagccttgcaccaacggggctggttgggcgagcacctgaacacccactagggcaaggagaggggcagcctgcaacagatagaatagggatgtgacatagggtttcttgacaagctttctaagatcgtatccctagagccttcctcaggaaggaaaacaaatatgatcccacttatttgtgagacttcccaagagattgtcgtgtggtggtaagaaaacaatttcagatatgtaaataggcttcataggggaatagaaattttcaataagagaacattaactctcgattctgattagtttagacatatcctctgcttagagagaaataggtaggttgacaagatgatctcttgagaattttctcagatctgtgatactatattttctctgggctgggtaatattccaattgtactacttgaatttatgataaaggaaatgagtgacaagtatctttttattatgcgttctgcacaaatatgtgtgcatgctgtattataagtctgcttgcctccacatttatttttcactccagtttgacattgtgactatgcattttgaatgacctaaataaagatagttttagaagagttgcctgtatttctgtatagccttggaagaatgacctctttaacaacaccaattccttcagcagtgattcatttgagctcccaatgggctgcaccagttctgtgtgttacaagggtatgtgaaaggctgaatgtagggctgtttaaatcagagtttgttagaggagtgttggggaagctgcagggccaggggagcagtcatcaaaatccggaaggcagccgcagcacgtcacacccgggcaccagaagccagggaactcagagcccatctgcctggatgccaccacagctgctcggtctttcatatgagaaccagattttgcatttgagggaaatggatgaaagcatcttgttcatttgtcttaaacttccaatgagcatataaaacacacaggaaactagcaagaggcaatatgcacagaaactagcaggaggacagcaccacgagaagaagaaacagcgaagcagaaggcctagagtagagaaagggagtgaagagtttgcactacagtgaagttagctaaaaagggtaaggtgtgtacaaatcaaaagagtaaagaaggaaaagaaagttattccagataggatggtgtagtacaaagagcctagagtcgcagtaaaaaggcttggcctcagttcaccaatcactggcagttttatctgggaagcattgctttacctcttctctagttttcagctgtaaaaagaaaaggaaagagaaaagcaaccaaccctgagtgccttccctgtgcacacacattacatatgtaacctctcttaatccttagttcaaccatgcgtgggaagtattattgacccccagtttactgatgagaacttggaggcataaagaaaaaggcaacctacctaaggaagcttaaagagagtaaatggtctgcccaagttcacgtggctggtatattgcaaagtggaagtttgaacccagatcaatctggtctagctcccagtttttcccaccataaaatgtactcgcccctctttatcacagaaacgagagtttaaagggcatagggtatatgaacgaaagcattttgacaattgtgaaaagcaaaatagatgtaaagaattcttattatttaaagtcaaatctctctagacaagcccacgatgagatagtggaaaactgtggttcagagaaatgtgctcacttgccaagtcagtgacactacttcccagatcaccaacagtaataaagtgagttaatgactgaataaagcttttaatggtgggttgggctacatgacctctaaggtcctgccgagtcagtatttctgagaatcaggaattttatcaaagcagtaagaatgtagctctgcgctggatctgacctcagagaaaactgtaatgtcagcaagttgcttcctttttgtctctcatttcatgtctctgttctttcccccactttcaacccccttgccaggcagtcatcactcttgaggctatctttaggttttgtgtgccacagaggtgaggaattcgataaacatatgcagactaagggagaaaaaggctacatttgactattggctgcagccctggaagggtgtgtgatctgggggcttatcattgagcctccctgaatcctggattgctcatctataacatgagaaaacctactcatagagagtgttgtaggaattaatcaatgtaacatgtaaagcgcctaccacacaattcaaactatttcgtgttagtttccttcagtcttccagatgcagtgactgttagcagaatctgatatccctctaagaggtgtctacatatacgaacaatgatacctggagaaggcaattctgtacagagtaataaccagtcctatggtggatttgtttcttgcggtgaggcatctgagtggaagagataaattgaggggaaaggagaggggagttgtatagatgggacttcctgggcttctcccagtttactccctaatctagccattccatagcattgtagttacatgaccaacctaggtacaacaaagtcagaatatttccttacttaacttgatacaatttcaattacttaaaatgactttttcttgtatcagagaagcttaaagaacggttgttgcatgtggacaatcaggtaaacctgacaaagtgccgtatataagaaaataattccagggacccagacggtgtttgtccagaaatgggccatctacagttacaataaaatattgaagagtttaacaaacactgatctgggcggaggaggagtttggagaggatgcctctcagtgcttccttccaaaagggtactggtcagaaagtttacagtctgactgcgaaagcctggatttctttggagtcaagtaatcacttatgtactgtatttacttctaataagctggagctgttaaagaaactgagactttcttttcacagctgtagagtacagggatttttgtctcttttgtttactgcatatttccggtgtctataatagagccaggcaatagacatatgtaaaacaagtgaattgtgaaggtgatacttccaagaagtagctcttcagaaccactctagatacactttagcaggcagttggctaacaaattcttagaaatacagtaaatgtggtatgatatctatttttttttaagcttagggatacttaaatgttactgccaagtattcatatgtgtgacacagagccttctcttacagcctttgccttttgttaataaacaataaataattccttggaagcatttgcccttcatgggtaattggagaaatgtttactttggtgatgggatgagaaagatgtgaccttttaactgttattcaactagtaggtgagggaaaaattataaaccagagaagataatattctggaaagctttcaaaaaataaaagaccaatgcggttcaatgcagtaccaaagttttctcgtttccagctctttttggcaaaaattcttcttagtcaaaaaagaggaaattattaaaagaattcatgaggtattcttagatatcaagtagtgcttttaaagtatattgttaggttgaaaggaataaaaatcataattaaatgtcctttgaaacccatatgtatttttaagaatagatgacaaggctgggcacagtggtgcatgcctgtaatcccagcactttgggaagccgaagtaggaatgttgcttgagcccaggagtttgagaccagcctggccaacgtggcaaaaacccatcgctacaaaaaaatacaaaaattacctggacgtagtggtgggcgcctctagtcccagctactctggaggctgaggtgggaggatcacttgaacctggagactcagcctgcagtgaactgagatcgcggtactgtgttccagccctggtgacaaagtaagaccctgtctcaaaaagaaaaaaaaaaaaagattaggagacaaattccagcaagaccacattttgtattctgttgaaaaacaaaattttgaaaatagttttaaatggttgaatacacagttctgctctctctatatctctccaacttacaaattttatcttggaaatgatagatttacttactgtccatttttgaattaaaaaggaaggaggttcagcattcaacaataataatttaggtaccagacctgcatgggggttggatatataaaacctgatttaaatactttatctgcttattttaaatgtttcatatttatcatttgtgtgtacatgtataatattttagaaatagttattttaccttatggcaactattcaaaaatatgtgcccccttaaaaatttgtttcaagctatacaggaagttaaaagagcagattgtctggctcaataccaggtacctggcacacctattatgacgctataagttcatgttgctctttcccttgaaaccttgagtgtgttttgtgccacctaggtgactgggtgaggtaggagacacccacaaccagttcctaggcaggaccctccccacagctgtggcaaggcaaggcccccaaagtcaaaagagagaagccctggagtagcagcaaacccgacaggcaggtttagagtctgggccctaattctgaaggacagcatcccaaagtcagagctggacccaaatggacaaccatcaaaccagtaagaccgtcagaagcagtaaatgcaacaggggaaaggtggggcccagaccatgaggaattccagagctggcctgtgatgtgcagtcttacaattactgtcagtctctgaggccgctagtggcctgtctctaagagttaaaggtgtcgatgaaggatgaacatatttataaattccttaagtgttatgttaggatctcatttaaggacagcgatttggtgttacctgacccaacactccgagataatggtccaggcaggatggagaagcaggaggatttctccccttaaagaagcagcagtgttggggtccttgtcctagagggatggctgaacctggtggaagaagggcatcccaagcaggctgccagagcaaggaagggccaggtgtaggggcagggtaggttgcaagacaagggagtagcagtctaaataagcaaagtaggaattagcctcagtgaattctggagactaagccagaactggtacagggaggtaaagaagattgtattaacaagattgtctactggggagaatgttagatattgttcaatgtcctttggagtggaggtgagactcgaagaggatggccatagataataacaaagagtctactaatttgccttctaaggagggtgacagattcaatagccaaaaagctggccgggcatggtggctcacgcctgtaatcccagcactttgggaggctgaggtgggcggatcacgaggtcaggaaatcgagaccatcctggctaacacggtgaaaccccgtctctactaaaaatactttttaaaaaaattagccaggtgtggtggtgggcgcctgtagtcccagccactcgggaggctgaagcaggagaatggcgtgaacccgggaggcggagcttgcagtgagcggagatggcgccactgcactccagcctgggcgacagagcgagactccgtcttaaagtactactactactactactactactactactactactactactactactactaaataaccacaaagcttttactgaggggactctagaaatttgggggccaagctggttagagcagtgtggatgaaacatagtggagaactgctaaagagagagacacaatactcatctagatgatgatgtctgagggtgtttccctgtggtatggatgttaactctctcctccattcctcccctctccccaaagaaatcttcagcaaattccatcttaattactgatgcttttgtgccagtggatgaaaaggtgggacataaaaaggtgctgtaggccgggtgcggtggctcacgcctataatcccagcgctttggaaggtcgaggtgggaggatcacttgaggtcaggagtttgagaccagcctgctcgacatggcaaaaccccgtctctactaaaaatacaaaaattaaccaggtgtggtggtgggcacctgtaatcccagctacttggaaggctgaggcatgagaacagcttgaacccaggaggcagaggttgcagtgagccgagatagcaccactgcactccagtctgggcgacagagcaagcctccgtctcaaaaaaaataaaaataaaaaggtgctgtagctgcatgaaggtgttgtgtggtagaaaccgagcacacaccaccttcagctgactgctgacagatcagatagccccctcttagccctgggtgcctccttccctggataagattgaacaaaggtctccacctgcttacctggtagaagttccgcatacttcctagcataaggtggaaggtgaaatcttgtgaccgcttttccagcccatatttcccctagcagtatagatagagagctagctgggtgatcactgggaatttagcaacttttccatgagaatagttaggctcttatcttggttccccaggaacatctttggggtatggagttgggtgtaggtgagctgaatgtagagctaaaaatgtggtgaacctgcctgcacaggggcaactggcttttaaaaaaagagtgtgtgttgggtgacttaagggcccactacagactccttcaattatcagcttgggcaaacagtctaaatacgttgttttgtgctgtaatgagaatatagttccttctggacaaagagaaaaatatggtgatattaacttctagcttgaagtagaataagtgaagctccagtctttattaataagtagatgatccaatgttagtgaagtggcttttatgtgccaataagttgtgtttagcagtcaggaatagaacacatttatcccttcccccacagccttctcctcagtccatgcaaaacaaattggagtgaaacaacaccatctgctcatttcacactcagtgaagaagcacgtcaactccttctcaaggttagaaagtccaaactcaaaaagacactcctctagttatgcagaaaaaaaaaaaaaaaaaagcctcctgaaagcaagaaccccataggcttagaagagtcccatatttcccaaaacatgacattgcaagggctgagttgatgagggctaaaaagctgagggcttccttatgagggtgtcacatggctttgtttcactagctaattgtatttctatgattttgtgcctctgatttagatggaaagaatggcagtagaaaaagactatcaataattaccatagttcttgtatcccggtgttgggaggaaaagaataaagaagaaagagaagtctggctcagtttgagaaggctgttttgttctgataattttcttttgtgtaacaaccacttttcttttggcaatcactttaaaaaatctaaatacttaaattaaactccattattttatccagagatgaggctttgaattagggaggaaactgagccatttgagtgtccctctatttactgtgctcagccaaactctgcattcagaagtaaagataagagaaagttcttactaattcatatgaatgccccagaaattagaggagggcagtcctttggccttgctaacaattcttaatctccacacagttataaccagccacctatttttaaaatgctgttcccaagaagaaccctggtgcgataggtggctggacttgttttagagaccagatatttgcaatacaaagtctgagaagaatcaagtcttgcaccaactatagcatacctcactggtactgataatttatgatattcttggagaaacaggagattaacataaaaggataaattgtggcatgccaagtaccaaacaagtgtgcattatgtaaaatcgtacatctttttattcacaaagctcttgtgccagagttttgagatttggtgaacaagaccacattaacttgaattcatccatccattcaaccatctgtcagtgtgtccatctgcccagcaaacattataccactgcctatggtgccagccctcagagttactgagacaaataaggcatggtccccgtcctggtgggggagtcagacttgcaaatcataatacctcaataagtgaaatcacagaagtatgttcaaggtggacaggtaatcaaaaaggagggagcagttgaaatatgaaagaaagattgcaatttaccaggcatgtgcattctaatcagaaggcacagcttgagcaaagcatggaggcatgacaaagcacagggtatccaaggagctagaagccgtgtgatattgctgcgggggtttgagtggcagtgataagagatgagcccagagaaataggtgcaagctagagaaagtcaaacctcataggccatgtttagacatttctctgtagacaataggcaacactggtgggatttcaggagggcatgtgtttagaataatttctgtgatggcaatgaggaaaactatgatgcatagaggaggaaagtgagaaaagtatagaaaacccaaaggggcaagttgtcactgtgttcaccaggctttttaaagctttgatcctatttcagcctttgtatttccagactgggaaatgccaatgtgagacaacttagtgtttgcaatatcacggatctcatagaaactaatattatttttaatagtatattaggggtcaagcatagtatggagtctgcttgtggccaagaggcctggggactccagctatcccaggccccactcaaccagtgcaaggcttgagggaatcagtagctcagctctacctgtaacccaatggagctgccccttgtgcctcgatgctactcagagtctatctacattggaaacgaatgaagtagtaataaataagctcaaccagggtagatctggaatccaaactccaattacaaggtttttccctcctaatctaaccacgctgcctcttcaagctgtgcttcaggagaattactctcttggggcataggaaaattcatagtttataaaagctaaacaaggaagctggggatattcagagctgacctcctagaagataatcatgttctcttattctatcaaagtcagaagaagaaaaatgaatcgtgtggttcacaggttattttccatgttgattagctccatatcattattcatagttgataaagtatctctgtcatccgatgtatatagacacaggagtttttggataaactatgaaagaaactagtgagtgagtgataaagctagtaacaaaaaagaagagtccagttcttctgagttacagctgactgtactaaccgtggttactttttctttcagagtttttggccaataatgttatttttaatttgctatttggcctatgaataattcatttaaaagaaaatctcaatatcttttgagcttattttagtgtccttattttagggcattgattaaaatatcagtctgtttagcatatcagcatgctgcctgtcagtcttcaggaaaatttcttctctctctgggctgttacacagttctggtggatttgttgtattgtatcacattgcattatgttaaaatatttccttcttgccattaactttacaatctggctgggtgtggtggctcgggcctgtaatcctagcactttgggaggccggggcaggagaatcgcttgagcccaggagcttgagaccaggctgggcaacatggagagacctcatctctacaaaaagtaaaaaattagtggggcatggtagcacgcacctgtagtcctagatacttaagaagctgaggtgggaagatcacttgaccctgggaggtagaggctgcaatgagttgtgattgtgccactgcactccagcctgggcaacagagtgagatcctgtctcaaaacagacaacaaacaaacaaaaaaccctgaaaacatcaagacaaaaagttacaatccacttattaaaagcacattctaattttttccttaatatttgtttcattgtgattaaaatagctaaactgacagttttgaagttatgtcaagttggcagaaacagtaaaagttatttttcctcaacttcatttctgtcttcaaagcaccacatctaggactaagaaagaaatgtgtgctgttggtaacattctacttcttagttgtcctgctgatactgccaacacagtagccaaacaactgtaataatttctggaaggcatctgtgaccttgacacttggcccattatgaacggcaccaaacccctccaaccatttcctataggtctgaaagctgctgtcaggcaataaaagctttcaattgttactgacttgggttagactcatgttctacttataaatttccatttagtgtttctattggtgtttgaatcagggaaaaggtttatttgaaatcttaaaattcattccgtatttctttcaatcaatataaatcaaaagcagtctcagaaaattgtcaataagtctggccaagtcagaagtaaatgtcaagtcttctgaaggttgcattttctcaaggaagcactattcaagcatatttgttagctcaattagtcttgatttagtagctccatcagtgagctaaggcctctggcactagcagagtaatttgatttctaaggtgtcagtaagagactaaaaactatccaaaatggtaaatccatgtcctgaaagcagacgtacagatcttgacattcttggcggcatagcagtcagggaaacgtgatgatctttgacactgtcttcatctgggatcagtgcccctcaatgtcacatgcctgggaactctgattttgaccatcagttcccggagagtgctgggaggtgacaggatggatgttccttttggaatgtcagttccctgaagtgatccttttacttctttcactgtctttagtggcaaaatgtacacgctgacagccctgaagacagcactgcagggcatgttttagaaaaggagaatgttattgtcaaagcctatcaatctggtctcttttccccctcacttcatccagaggccacaaaactaactttctgctgctcagacacgtactttgagaaagtgtagtcacattgtaactggggctacttaggacctcaatccagttggggaagggtggcttgcatcatctaggtgaggggtgaagagaacgggaccaagataacctaaaccactgtattatatccttccctctcttaactccctgctgaactgatctgaccagtgtaacatacaaattaattatttatcacctccaggaattagaaagcaatctgcctggcattcccgtctcaagggtaaatctaagctggttacaaaaaaggggagggttcattggaccaagactgaggagtttcacaaaattgaaagtgtagttgaatgtactataggtgcagagatccagctggccgtcaggaacaccagaaactgggatgttaatgacattcaaatgttgtctcattcatcacggctaagattctgtatgtcagcttcattatcttttgttggacactcgttttctccacatgttgaaaaacatggcctcagacatttcctgggttttaaattttagaccttaaactactggtctcactctctcagtacttcaagtgaaagtattatgggtttgatttaggtcgttacccataaatgaaccagtcaactacagacagtggatcagggtagtgtgattagccaagcttgggtcagatgtctgcaccaagctcaattaactgtggccaagagatgaaggtcgtactgtaataatgtggtagctctagtggcaaccacgtggttggaggaggaatgaatgacaggcacaccctcaggtgtccattatacatagctaaaacaaaaagcaaaacaattcttaaataacagaaaagcaaagatatatttaggcacaaataaacataaagtcaaatccaaagccaaagccatttattaaagagagtaattttattttgataagtatatttcaaaataaaaagatgttaataagttctacaaaatcaagtaacatattatcaaaaacacagtaaaacctatgagcgatataagaggaaatgaattgtgtatctataaaaccaaagagattccattaaaaagctatttgaattgataaaaaccaagttcaataaaatggtgggatgagataaatacacaaaaatcaatagttagcctgtataacagcaataatgtattaaaaatgtggtgaaaaggaaatcctattcctaatagcatcgaaaatataataatggtagggagtagactggaatgaatatttgattgaattagtataaaatttattcagaagaataaaacataaagaataacacaggctgggcttggtggctcacacctgtaatcccagcattttgggaggccaaggcaagtggattgctggaggccaggagttcaagactagcctggccaacatggagaaaccccgtctatactaaaattacaaaaattagacagatgtggtggtgcatgcctgtaattccagctacttgggaggctgaggcacaagaatcactttaacccaggaggcggaggttgcagtgagccaagatcacaccactgaagtctggcctgggtgacagagtgagacgctgtctctcaaaaataataataataacatacatgcacacacacggacatatatgttaaaggcaagaataatgaagggtagttagccttgccagatattagaattaaagcagtatagtattgatgcaaaaataaacaaataaatgaacaaaataaataatcttgaaattgatcgtgatatacttcaaatatgaatatgtgataaaagactgcataaaccaaagaatgagaaactattattcagcacagagtattgggacaaccagtggttatgtaaaaagagagtggcacattactaaagttaagaatcaaccaggaatctggtcaagttatttgtggcaaatatgataaaaattcatttttgactcattaaaagctcattcaaatcaataagaaattccagtaagcggtgtttataaaaccgtataaagactcaacaatcttacctcaaaggtggtaatacaattggtacaacactttggaatttaataagcaatacatttcaagaacataaaaaatattcacattccaaattagccgggcatggtggcgggtgcctctagtcccagctactcaggaggctgaggcagcagaacggcgtgaacccgggaggtggagcttgcagtgagccgagatcgcaccactgcactccagcctgggtgacagagcaagactccgtctcaaaaaaaaaaaaaaaaaaaaaaaaataaataaatatatatatatatatatatatatatatatatatatatatatatatatatatatatatatattttcacatttctttattcaataattttttccttggtaaaccatcttgacaagattatttgaaaaactgaaatgtattatggaccaatctactcatcactacatatatactcattgccacattactatataaaatagtaaccctgttgtcctctaaccctgttttcctgtttttcttttcatggcatttattatcacctgacatttgtttattaccagtccctccccaaccactaaaatgtaagccccatgagaattggactactttgttcactactatatttccaagccccagaaccctgcctaacataccctaggaagttgataaatagttgtggaatgaagaaacaatttcaaacatcccacaataaagaaatgatttggacaattatgatttatctattcaatataatattatgaagcaattatatttatttataggaataataacataacatgggggaagtatttataatgaaatgtttaagaagaatatagtttcacacgtatattatgattacaaatacagaaaaagaaactttgtggagagaaatagaaatggaaggagatatcaccaaacattaagagtggtgtgggaaaagagaatacaggtacttttcctcttctatctagttttgggcatttcctaggggtgccacaacacgcatttctttactattggacaacttgataaatgcaatatataacaagagaagttttttttttttttttgagacggagttttcctcttgttgcccaagctggagtgcaatggtgcggtcttggctcacctccgcctcttgagacggagttttcctcttgttgcccaggctggagtgcaatggtgcggtctcggctcacctccgcctcccgggttcaagcaattctcctgcctcagcattccgagtagctgggattacaggcatgcgtcatcatgcccggctaattttgtatttttagtagagacagggtttctccatgttggtcaggctggtctcaaactcctgacctcagctgacctgcctgcctcagcctccccaagtgctgggattacaggtgtgagccaccacgcccagcaaacaagggaagatttttaaaaatcacccatgataagaggatacgatttcaaattaaaataatgacaagtagggaaaaggttgggaacagtagaaaattataagttaatgttttggtttattttagtataattagataagtttgggtttaagaatatgaaaatatagaaagctgattatcctttgagtcactagacaaaaacatagtctattttgcttactcctgtcattcaaccacattactacccttaagttcctcctatgtagaaattctgaaactaacaggtgactctaaatactcctcctgcagtgttgccccagccactgcagttcttgggtgtccacccgagggtgtgtgggggagagaatctagacccctagttcaaggaaccaatagactggccttcctctgccccctgggcctccgcctactgacccagacaccagaggctgtgttaagctgggccgggctcttcacagtctaacgtactcaatgcaatacattggcttagtgtcaccatggagtcagaacccctcatcctggtggccattgttctgtgggcttgttttataatgctctgcgcttcctccttagcattacaagctctcagtgctgagcctctgtcccaaccatttcctttgttccccccggaagtcccattggattgtaaacagatgcctccacatccacggtcctcacacaggcactccttctatctcctgctttattcgaaatctggcactctcccgaggccacttctgcagacctcatttgttcagatatcaagtgaccagtaggtgttgttaataatctcctgactgtcccctccctgccatttcaccatcatttcacttatattcttggtcaaaaacaaacaaacaaacaaagccaagcaaaacaaactcaaacaaaacaagaattctgtcggattctgataatcttgttgtcttagtccatttgggcttctataaaaaaaaaataccataaactgagtggctcacaaataacagaaatctgcttctcacagctctggagcctgggaagtccaagatcaaggcgacaacagattcagtgtcttgctgaggcccactttctcatagatggcggcctttccttgtgtcctcacatggtgaaagaggcaaggcagctctctgtggcctcttttataagcacactaatcccatgatccaatcacctctgaaacaccccacttcctaataccatcaccttggtgattaggtttcaacatatgaattttggaggaacacaaatattcagaccataccacgtgacgtccaactcagtgtcttttttccccccatttcatgactgacttctgacccactcctcaagaatcttaagtgtacaatggcttacactctttctctcctccacttcatgtcttgccatcctagatgatttcattggcctgtggacgacacatcttttagccacactgtccctgctcgctgccttctctctctccccaccaccttcaacacctaggaggagattgcatggcaacacagagggcaggaaaaggccaataccaaataacattctcattggctccttctccagaagaacctggagagagacaactctcttttttgtttcccaatcagtagtaaagttgagggtgccttctgcttgggagtttctcagtgagtatggcccagcagggataaaagaaaggggccaaaacacaggtagcccttataaaggacataagcaaaatgcttaaatgagattcttgaggtttttatgttgtctagttcagcactccagtgttggagagcagattgtggggagatggggaggagtcatagcttggaataaggagtttggttgtcctctggtaatctctttttttggctgcctcaaatcctctgtggaaagcagcttgccatatgcatgactctgtgtgtgtgtgtgtgtgtgtgtgtgtgtgtgtgtgtgtgtgatatacaagctcagtgacaggcaaccagatacagctgagtccagagcagttaaaaggaaatcctgaacatttccaaaacatacaagtaacacaccaaaaagcaaatgatgcaccaaatactgttacctaaaatttcttggcttccttgactctccttcaatattctagtctgagatacataatcttctatctttatgttcttacttcttacttatacatagaaaatctactctgatcttcttaagtgctctaattcccagacaccctcattttcccctagtcattctgcccattctggatttatttccttccctatatagtctaaaccatgtcacttatcactacaattcacttttcggcatccttgagtccttccattcttgtttttttcatttctttgcccatgcctagaaatccccaactctaggccaatccaactatccaccttctcttctcttaccatttattgcctcatgagtaccacatagagaagaatcacaaatgtattattactaatttcagccaggcccctaaattgttccctctcttaatcccctgtgtgactcttccaggattttaccactctcctcaaacactctaccatctagcagcagatgactttgctgcctacttcatggaggaaggatattaagaccctcaagaatgaactttgtatcctctcacttatctatctctgcctccttccttcctggttcctcccatccaagcaaatcccttgacctggtatctaaattccttcccttccacaatttaaataatctttatatcaacactaaatgtttattcttttcttcttcttcttgttttttgagagagagtcttgccctgtcaccaggctggagtgcagtggtgcaatcttggctgactgcaacctctgcctccggggttcaagtgattctcctgcctcagcctcccgagtagctgggactataggcgtgccccaccacatccagctaatttttgtatttttagtagagacagggtttcaccatgttggccaggatggtcttgatctgatggtcttgatctcttgacctcgtgatccgcccacctcggcctcccaaagtactgggattacacgcatgagccacgatgcccggcctaaatatttattctttagacaaatatgtattaagcaccaggtaccaggctgggctattgggataaagtgacaaatagaacccagttacaaaagatgcctgttgaattgcttgactggcaccccttttctgtgaattgcatgctctgcttttatttactggttggttgctctgggagcttccatattacaactctcacccactggcctccctgagtaactagtttgaagtgggcacctaaaccaagactggcaatcaattcgttcaatgggaaatttgtaattggaactggcagtcagaaccagactgtaaaacggtaatttggaagttggtagtagccatttactgccatgtggactaagacacagagagagccattctgcagtgagaatagagctgagacagattcagagaatggtgaagagacaataggttctccaaaagaggattttctggggtttttaaggtgctccattctccagttccatttccaaggcccagatgcacccctgtcataaaatgccagggtccttctaataaactttatttctgcttaagatagtattttgtggccaggcgtggtggctcacgcctgtaatctcagcactttgggaggctgaggcgggcggatcatgaggtcaggagatagagaccatcctggctaacacagtgaaaccccatctctactaaaaatacaaaaaaaattagcagggcatggtggcaggcacctgtagtcccagctactcgggaggctgaggcaggagaatggcgcgaacccgggaggcggagcttgcagtgagccgagatcacgccactgcactccagcctgggccacagagctggagagagaaaaaaaaaaaaaaagaaaaaaaaaaggatagtattttgtattgggtttctgtcacttgtaagcaaaaagcaagatcctatcatttttgctggaaagctggcctgccttgttttacaactattgtctgttgggacccagccatgtgtcttttgaggatagaattctaggggactaggtagcaaatgtcaggatgttgccccttattttcagtattcattaagatactacaagaactaaacacgttcaaatacagctgaagcctgcctgggaaccacagggccagggtgtgcctctgttctgtgaagttctttcgccttctgccagttgcctgagactactgaggtcagataatcatgggctttgcggaataacggctgccaaattatctactgcaccgtttctaaagctatcaattatcccccttctctcttaaattttcaacacttccctctctgttggctccttacatcagcatttaaatctactcccctcttaaaatctattctagagttaccaatttttccttcctattacaggtaaacttcttgaagtagttcatactcagtgacaagccatagcaagtaggtggccttactctctgctgcaactcacttactaaggttgtacttgcccacctaccttatcactaaatacaatgaatggtttccaggtcttatcttatttgatctttcaggagtatatgacactattgaccacttctgcattcctgaaacactttttcttggcttctgtgataccacatgctcctggttttcttgttacatgcctgcttgtttctttgtaagtttctttttttgctctatgccttcaatgtgttggtgttcttccagtttggtcccagtcctcaatcctcagtcctggttccatcctaaactctcctggggcaatctcaatcactctgttggcattattgtacctacccaaatataagacagagccctcttaccctcaccaaaatcagaaaacagggagtcactttatattctgacccttagaagtccttcatggccagtcgtggtggctcacacctataatcccaacactttgggaggccaaggcaggaggattgcttgagcccaggagtttgagaccagcttaggcaacatagtgagcccttgtctatgcaaaaaaccaaaacaattagcctatacgggtgtggtggtatgcacctgtagtcccagctactcgggaggctgaggtgggaggattgcttgagcctggaaagtggaggctgcttgagctgtgattgtgccactgcactctagtctgggcagcagagaccctgtctcaaaaaaaaaaaaaaaaaaaagtcgttcatgttactggatgctctcaaccattttgaacaacaaaatgctttttggtggaatacacattagcatgaaatgctctcattcaatgctcatacaaagccacctgacagaattggtaagaaaggaaacaaattgaacagactttaaaattacttctagggaaatatcttcacacttagaagtgttggatgtccttgtaaacaagtctttaaaagtcactataaaaagcaatatggtacatgaatataattacaggatgaatgatgtagtgtgattagatacttgtggcttggaataaaattcccagtgacagcattatatatagagttaaaaacttgggtagaagtgaagatggtatgtcctgggaaatatgttagagactcaaaatgcgacacttgtgatgataaagacaccatgaagaatttcaataaaattattttaaagattatatttatataatacgtaatttaaagtaagcataattaaattaatatattcaatattataaatagagccctgattatttcttttttcccaactttttctttcttatttaatttttttaacttttattttaggtttgggggtacaagtgaaggtttgtcacacaggtactcatgtcacaggagtttgctgtatggattatttcatcaccctggaattaaacccagtacccaaaagttattttttctgctccagtctctcctcccaccctctaccctaaagtagacccgtgtctgctgtttccttctttgtgttcgtaagttcttgtcatttagctcccacttataagcgagaacatgcgatatttggttttctgttcctgtgctagtttgctgaggataatggcctgcagctccatccatgctcccgcaaaaggcatgatctcattcttttttatagctgcagagccctgattatttcatctatatctctaaaagtttatctgttcaagttggccacaaagttttacggggggggattgtttttgtttttattttttgaggcatggtcttgctctgttactcaggctggagtgcagtggcaaaataatgtatcactgcagccttgacctccaggctcaagtgatcctcccgagtagctgggactacaggcacacgccaccacacctagctaatttttttttttttttaatgtagagaccgggttttgccctgttgcctactctggtcttgaattcctgggctcaagctatctgcctgcctcggcctcccaaagtgccgggattacaggtgtgagccgccgaggggcctgggggagtggggtggattctaattggaaaaatggaggctcaccttattttcagaagcaccttatactcaggcatatgtagtgtatgctgatgactcacttctccagtcctatctccctgctaaactccagatccaagtaatgaacggcttactgatatttctactcagatgtatttaaagtacctatgtatgcataggtactttaaatttccttgtccaaagttaaactaacattgtctcccatctgctcatctttctcattcccccctcagtgaatgccaccaccttcattcagcttcccaagttgaaatctgagttacccacatctcctatctctcccacacacccctgctgtttctatctatctcctaaatctctctcttatctgttcacttttcttaatcccctttgctttactccaggccaccatcatctcctccctagactattgtaacaaaatctgaactgtttttttttttttttggtctcgacttcttccaaactacactccaagaagcagcctcagtgttccctctaaaacgcaaatctgaggtcaaatcccacctgtaggcgtggctgactcctatctaccttcaggtctctgtttagaggccaaagcttctctaattctccttctcccacccccacacacaatttagtcaagttagatgctcttactaagttttcccacactccttatctttccttaccataacagtctttacacttctttgttataattgtttaccctttctgctagactgggaactttgtttatctggctcatcactgtcttcccttaacataagccaggaccagagacacaggatgtactttataaatattaaatgaatgaaccaataattttgttatcccagcatccagcacaatacttggtgaaaacaggtcctcaataatttttgctgaattaatagattgttgttgaactaaagatatgtgatcaactaagcaacatgtgacaagcaaaattaatattgagcatgcttgtacttaaaaaggagcacacatcctttttaattacgcttaatcagagatggctccctagagcaggtggcttctgaaggagaacgggagaaaataaaaattcttacctagtggaatgtaaagggcaaatataaaaataacaatctctgtgcagaagaaaatcactttcttaagactggggcaacttctagttgaagtctgctgtgactaggaagtgttctatcctgagatctgctagtcaggggactagctttcttcttctcaacctcggacactgggattcagccagggaatcagctgcagaatctcattactgccagcagttaaacactgaattgtacgtcctttctaatgttgaaaaaaaaatccttttactatagagaataagattcctaccaagttttatattcataggctttaatatttcatgtaatttttatatcaaaatacattagcataaatttcacaagatatcagtctagttatttttggcctgcatttcgataacttttacagacacacaatggccactctgttttctttgctctaaagtttctttgtgcacttattccttgaacatgggcctcatgttctaactttacttagatgaaaaaactgttaatttcaccagtggtttaatatctcttcatagattgatagtttagacaacataaaagtgttgattagcagtatacgtgcaggctgaagtatttgttgaaaatcttgttgggagaataagaatgataaaagagatgcctaagaaaatcttttctcagatatgctttactaaacaaagaacaggttaattactcaatgatgatttttaaagggcatgtcgacagtgtcagtgactttgaaacaaagtaaaggagctgaattcaagtgtgtgcctgagttacttaactatcttgaactgatttaggatctgtagctttaatctggggctccatctactagtggtttaatagagtgggttttattaaaattgtgatttaatcagaagccagaaatatacaactgttttaaactttttgatattaacctgatatacacagtgggctgataaattagtgagacagttcatataagtcatatatgaaaatcagtctgttattagccacaactcatgtatttttcaaaacttggagataaatgtaagcttcatctcagaagtcatattacacgttataggtttaatataatgaaatttttccagacttagaaaagatatcaggaaattaacatttgcaaggcaatttacagttttcaaagagcttttctcattaattatctcagaaaactgaataatgatgtgattattaaaggttaattaagcaaatacttgtgaagtaattgggaggtaatctatttctaatttaacaggtcaatcacgggtatttaggaaatatttttgctggttaacaactctaaccaaaacaaaaaggtatttaaatggtttccctagtgaaaaaccataagcatgtgtttcctctattaagtcaattgtttcaaagaactagcatgagaattcctaatttcaccgttttgatgatttaaggttttatgaagattctgagctcttccctcccgacgttaatccatgtcttacattgttcattttggcgctttagaataaaatatctttggaaagtaactatgagaaagcacagagggatatgttagtgaaatagccattttcttgtgggaagcaagacatttcggttatcgactacacagaagagtgaataaaacccaacgcctatcaaccaccaaacgtgactctgcttgcataatcatacaaataaattttctttaaaaatttttcatgggtgcagtatataaaatgatcaatagtctcatcagcagtggaactacaaactgctttctcctaactttgtgtagcctgggtgctgcctcacgattactaagtggtttaaaatcatatcccacttgctccttggtttatcagcgaaagacgtgattcccaggtaggaaaacgccaagtgtcccgcaaaggtacaggtaaaacgtagcagttactgcgagaagactggccccggggagtcccagggctcggtcggggcccccgcacgagctgaggaagtggacagcgggcacctttgtctgtgcctagttccctggacccgggccgagcgatgcgggtgggggcgcggttcgggcgggtcccggcgctgcccgggggaagcgcgcggcgacggcggcccggcttgggagccggaggtcagcggctgcgcggccggccccctcccacgggagccgcgccagggcccagcaagagtcgggcgggatcgctattgtttttggcgagcacataaatccccgggccgacccactgcgcacccaggtttcctcccggaggcctttcggtttcctctgaggccctatatagaggctccaggcccggactgtgcagaggtgcgcgcccacgccggcctcccggaccagcctgagctcggagcgcctctcgccctcaggtctctgcagccagaggcatctggggaggtgaggggggaatttgtccccgaggcgaggaggaggaggcgggggcgcgcggagccgaggggctgcggcgagcgggcgggaggagcaggaggatccgcttctccggggtttccctgacgccagcagcagcgcccggcgcgcgcgccccgcacccgtcagcggctccggggagaagggggaggggagcgggcccgccacggcccgagaggcggcagccgggattggagcgggggcgggccgcgcgcggagccgagggggtgcgggcgaggcgcgcgcgtgcgcgtgtgcgcgcccgggactcccgccccccgcccccgcccccgcccccgccgtccgcggtctccgcccccctcgcgctggtgtgtggagccggagtcggcggcgggtggcggcgcctggaacctggagaccgacccaccgcccccccccccccgccccggaatgtactgactccccttcttcgctctcctcccctccccgcccccttgcaggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggtaagcggcgggcgcgggcccgggggttcgcgggggcgcggcaccggctcaggcggccgcggctgcggtgtttttgtttaggatccaggaggaaacgtgcaggaacttctctgcctcggctccggttgccgaagagaaaggggatcgcgcgtggtggggaggagaagggcgagagggggcgccaccggggaaggggcggctgccggggggcaggtcgggggcgcaggggtctagttcccagctttgtacctggaggcaggttcacccctcgcctctctcccctcccccaggctcatcccacttgtaagagtgggacattcttgtgctcacactagcaccagtagaggccactacacacctcattaaataaacaatcagacggccaattcattaattttcaggaaaggaaaggggagggggcttgagctcctggttccctggccagggatttcccagcttccgaagtctcgaggaagagctggctagtctcgagggactcctcgcgcggggattggagcccgagtctgcggaagagcgggggtgtcagaggggcacaattgcccgctcacaacccctggtgttgatttaacgatgaggacgccttggagagcggctcggagtgatcgtatctgttagtgtttccgttatgaaatgcctcttctttcctggggattacaactatatttacagcctattaaccactcttaaccaagggaattgtctaagcatcagattttaggtacttgtacaatgttttcagatggcattgtataaacattgaacctcaaaagccattttcagttcttttttggaatattatagattactgaaaccacctgcattcctattaaggggaccaacgaacaaaaatgccaagccttccgggaaggaccttacggtattgttgagcaggatacactcagcagttgaaaggcaaattagcatgtaatctgttaaaattatttgaccaaggtggtgtaccataaaacttgacaaaactttcactcgtgtgagatatgatatttttacatttgaaagcagtcttaccgctgaaccagtacttgtttttccctgatttatatgaaataatatttaaaatcacactgcaaggtaacttgactgataaacttttcatttccttgcagagtgtgtatgtagctcatggcttttgccaatgttaaagaacagctttaaacgtaaagtaccactcggtattctctaaacagctacgtaaacaatagtgttttaatgtcaaattaaacatcacttatgtcatgatgtacccttatacattcagtccgtatatggtttagaacacattttggtgctgaaatgcaggttactgatccaactgtctcttagatgagcaagagaaatataactattttggaaaacaagttcctgttactcatgatctattttatatggaaattcatatgtagttcaccaaatttcaagtttttgtttaaagttttgccgataattttgtaagtaactaaaatgctagtaattttattacttaggataataaaaataatgcaagcagtctcaggaagtggtcttaacatctgtttcaacattaactcaattgacaggtttttattttgcacagatgaggtgcaaggcatatgctctctgccttcatggagtttacagtctggtgtgtgggtaggaaagatagccatccatctactgattatataattaagtaattgtgataagcactacaaaggagaataggttttcacaaagtgggtactggagtgacataacctagtctgggtgttaagagtgtctcacaagaactgagatctgaggagtgggtaggagtggaggtggggaggctcacaggtaattagtcgtttaattgggtctagaacatagatctcctgattctcggtccagagtccttcctgtaaaccgctctgcttcattacaaaagcgagaggaataactgcaataaggaggggttggtcagttctgccataaaactgcggaagagatcaagagactggagaactgagtaagcagcaactggaacaagctgtccgcaaatcagatgtcctttgtcagtagttttattttttttatttttgtagagtgatagacttataaatctttttataggggattatagtgaatagattgtagggaagtggacatgttcagtagtagaaggtggagaaaaatagagatgtgggacaataggataaatggaaagtgtttttccatctgaggttatagacatacggaggtggaggaaaaagtaagaagtaaaggactggtgatagaaaatggtcagcaagggaggagggttggaattgagtaggaacataatctggtattctgaaaaagggcagattactgaaaagatatgtagagaccttggggaagatgacatggcagcagcctgtgcaatgcatgtcttctctatttagagtgaacattcttcaccgaggactctgtagcttctgcctgaaccatttatttcatgatgtgattcattgccttacagggtagtccatttctgtgttgaataacttctgttagaaaatgttgctttgtacagtacatttcactgtagttttcaccctccccacccttcttacattttttcctctttgcttacctttttcagcattactctatcttcaggttaatctcttctctgattaattcttcatttgtctttctggcttttcttgaactcactcacttaaatattagtatctaaagcttatctcattatacatactctgtttgccctcagttgccacctgtaagctaaggactctcttagtccacactttctcacttgccactcggtaccttcactaaataggatcttaggttactgaagtccgaagttaaactctgtgtcattttccctcgtgcttccttcatccccattctctaaacatgaacaaaccagttcctggcccctgtgtctcatgttgttggaaggattgcatggatttgtcttcttgtgttgcctgtcttggtcatcactgttcatccacttgcccaagctgagatcaagaagacctcctcttcccattgccatagcggatagttctttttgctttttacctctcagctgtttcttgactctgaatcggtatcttttcatcttcatccccacctggactaacagtagtggctccataattaatctctttgtctgtactgttaccctctagaagtctgtcctgctagaatgagcttcctgaaatattttcctgagcatgccactctcctacttaaaatctgttactagtgttctgtagcttgggtgttagaactctttggcatggagattgtgaggccctttgtattctttacctctgttctcccaaacccaataaagcctcatctcttgtcacccctaacatgcaccttgcattccaccactccagattaacgacacagcttcagatctccgtgcctttgcacatgctgttctttctgttaagtcacttctcaccttgtccacttctgaaactccttatctagtcaatgaatttttctctaccagctttctcttccaaagagagttatggtcactattctgtgttcccatagcttcctgagtacttttcatcttctgttacttattttcttgtcttttctgctagtctcaacctctgaaggggttggccgggttgtcttattcacctttgtttccctagtgtagcactaacatgtagcatagagaagataaccagtaaatgtttgttgactgaatgttgaattgcctttgtttttaacccgtagggccatacagcacaaatctgattcctttatatgatggcccttcatgtgtctaatcacatttcctgtgtgcatgtgtgtgtgggccccccctgcccttcccctcaaaccttatcctttttaagttaaccatccttaattccttcagccactcttcacattacttagtttccagatcttttgtgatcttggtcatcctcctggatatgctgtagttttagcgtttttttagttttgtcatctttggaaagatctttgatcttactgagtcatctaaaagaaaagactgatggcgttgctctgcctgtctgttagaatgaggcacaaaagagatcatagaattctgggatgaatgctcaaagaagataagaaatatgactgattttcataaactgtatgaaaattaatacatgatgtgagatagtgaaaagacatacatgaaggcagaggatatggggtatgacttgtggttctgcaacttcacatacatctgtaagttgggggatataggcaggcaagaataataccttacctacctaactggattgtcagaaaaataaaatgtaaaattgttcataaactataaagtactgtacctatgtagaatggcttcagtgtttctttgtgaactctaaaaatatactatattaaattatttgaaagtgtagacttttttttcttttggcttaattgatcattgctggtttcttccttatgagtttttctctacctcaatgaaaatattggggtaaccttaataaatctcattatatggaggctgtatttaatagtcttttttccaaacactttattttattagtgacttccatgtgattgggagctatttaccatatcattggtaagtgtttaggtttctgggtaaaattgcatcaataattggagaacagtcagaggaaatgactgtaggtaagatcatattgaccggagagctaagtgaagtgaggagaagttttgtgtttacgattttgaaaaattaactttgtcatggacatagctagtgaaagatgattttaaaatagagctcaaattttggattcatttagaatgaagagagtttttttgattcaaaaattttgtaaatagtgacaaaaaaaggcattcagacccactggtatgattttggtatatttctttctacttactgcctatatggcacattatctttttacattgtaatcatggtgtatgtataacttgaaatgttttcctttgacattataccatttttctttgttgtcacattatctttaaatcattttattttaaaaacttatttaaaaatacataaatatatgtttgtttgcagtcaaacaatataaaaatacatagaataaaagattttatcacttctacccacaaattccatttttgaaacccataagtaaccccttttaatatcttcccttgcatgtgcatatgtgtgtatggttttatttttttacagataagcaggatcatactacctattgttttttcaacttgctttttcacttagtatgttggagatcgttccatgccagtacatacagattttcctataaccattatttaaaatgtgtgtgtaatattccagggagcaaatataataatagtggctaattaaagtagtagttacagaacactccctgacttccaggcattgtgccatgctctttcacatgtatttaatcttttatacagtcctgtgaggaagatgacaatttcttcacattccacagatgaggaaactgagtctcagatattaagtgccttgccgaaggtctcacaacctttcatgtgcaagagttggcattggaatccaggtttttgcaacttcaaagcctatgttctttattcctctgcattctgctgctaattgtgtattctcctgttatggatatggaagttgtttttactgttttgctgtgataaagaatgctgtgatgaacatattctttctatattttggattcccccatataggattgctggtgaaaagttaacttgtgtgtgtatgtgggggtcagggttccatttattgcagaaaagtaatgatgtcattaagaataattccattgactaatactttcataactttttgaaggttttaccacttttaattgtgaactttgggtacttaaggccatgttttaaaatgcaagttcatctgttaactgaaaggttaagctaattaataagtaatttcaaaggtcccttctgccttccaggtttctcttactctgaagtccataaaatggaacagtgggtttatttcagcttaataacttctattcagttattgtgttccaacactggtcatttctggttttcagatgcaaaagtcacctttttttcattcgctaaagctcaggttattgtatatcttttttttgtagtgcaaagtaggatatgattggaaaatcgtctatgttacttgcaaatgattgtatatgattttattttatatgtgtaaaaatagctttagggctgagttatatggcttcagtgttaagtaattgtgaggtattttaagatacagtattaccagaaatattagatgcttactcttaggcttggaagggatgtagagtaaattgaccaggttacagagctggcttatgtaaacaggttttgattccctgtctgacccctttacataaagaaaaggcagagaggtatggtggttatatatgttttattttactgaatgaagtcagttcttcagttctgaggagttagcaggttggtggtctgaagtgcagattacgtgtctctgcttttccttttttaaagaaccattagaaataaccttctttaaaattatttcatagcgagaatccttacatttaactttttattaagtcagttctataggcaaagctaggagttgcagtaattttggctggttgcaaacgtttatctttgagggctaattatgcacaaaactacactgtggaaataaagatgaattggacgtgctttctgtcctcaggaagcatttggtctaatggtggaggtaagggagatattaggtaacttgatttggcgagagaaagtgccattactgctgtaggtagaaaaatacattctggaatcattgtgttactgttgatcaaggaatagtgctgctttccctcataattttggttctgtatctttagagtagtcctaacttagttttataaagccagtagactagaattctcaagaaggagttatatatcatttcctctgattactgcagtgtttgaatgtatgagaatgctcataattgagctgtctgggggtacagctactcccatgttttttggaaatctggagattgatcatactgattttcagaattgattattggtcattaatagtacaacttactaagaagtcctgagcagagtgaatttttgtaatgatactatgtggaaattgaaaacagaatgtttctgtttttctgctgtagtggtaaaaaaaaaaatcaccaaaatatgtctttatttatgaggtctagttaagataatagcattataatttacaaatttagggatagaataacaaattataagtttcattcataattttttaattcacagcatagctttaaatgtaacaagtaaaatttgaaaatctttttggttaattgttgaaagtttttgaagttggaggtaggataactagttttgtttgtttgtttgtttgtttgttttttctgagactgagtctcactctgttgcccaggctggagtgtactggtgcgatcttggctcactgcaacctctgcctcccagattcaagccattctgctgcctcagcctcccaagtagctgggactacaggcgtgcaccaccacaccctgctaattttttttgtacttttagtagaaacagggtttcaccattaatggccaggctggtttcaaactcctgacctcaaatgatctgcccgcctcggcctcccaaagtgttgggattacagacgtgagccaccgctgcacccaggcaactagttgttttaaatttatagagtgttgtatattcaagggattgtgtgcagaaattcttgtggtgataacccttttatttatttatttattttgagatgggctctcactctatcacccaggctggagtgcagtggcatgatcacagcttactgcagcctcaaccttccaggctcaggtgatccccagcctcagcctcccaagtagctggggctacagtcatgcctcaccatgcccagctaatttttttgggtatttttgtacagacagggtttcaccatattgccaaggctggtctcaaactcctagactcaagcaatctacccgcctcagcctcccaaagtgctgggattacaaatgtgacactgcactggcctaacctgtttattaatcgtacctcacctacataggactcaaccattatgcaacctacctccggaatataactgaagactagggaataagagaaataattttcaaagtaaatgcatttctccgagtcccaaaggactttgttcagagcctatctttaattcataggcagttctaacaaacagtataatctaatttctgagcccatagctgatcagaagtgggtagaaagactatcttgggaaatgccccctgcagcagaaggtagtgacagttgcaaggaaagatacttaaaataagcgtaagaacacagagatatcttcccataaacggaagttactgtctcagccaagttgaggaaaatttctttccctttccattactgctaatggatattgcctacccctggcctttccttttatcccctcctactgtagatacagttgctgtctgggagatagatcttccctcagaaatctcttgagtcttaatctctcctcaaattagtaagggttcaggttgatgcctgaggtaggaagaaaggaagtgtgaccaggaggggaggtgaggtggcagggtatggttcctacccctctggccatgacatttatctttattaacagcgttactaaacctgattgctaaaatatgtatgtggatttttaatttgggggtaaagttaattgttgaatttttattgttaaaaatgtaacagttcatactatgtaaaataaaatgtgaaatcatacactccaacccttcttcccagagtaatcacttttaatagctatggtctattttatatatacaattatatacttaaaatatctggtacatatataacaacaataacaagttggattttgctgtgcacactgacttttaacttgttttaggacatctttccatgtgagtgtgtataaatttatgagttgtgttgatagccatatgaaattgtattttctggatatatcataatttatttaaccaatttctttttgatgctcccaaatttttgattgcaaacaaatgatgcagtgaacccacgtttataaatgtccccatttgtgcacatgtgcaagtaaaccatagaataagtttgtgggtgtggaattgtagggcaagagggcatgtgtagtcacattatttccaaattgtttactaaacagctgatttacactcctttgagcagcaaatgagagtgtctgtttccacacttccttgccaacatattggttattttcagacttcctagtctttttgccaatttgatagaagaaaaaaaacctctgtaaatttcatattttaaaattattaatggagttgagcatcttttcagatttttattgatggtttatattgtttctgagaattgcctattcatgtgttttattcatatatctatatcttttattgaatcattgattcatttataaatatagataatacgtaattaagaataggaataatttaaaactttataatttgtcaaaacttccatagctgcttgtggttcttaacttagtgataagcaaactgagtaattgggttagttacctgactcctgctaaccactgctcatgctaacctgatgtggattcataagctttaaaactgttctgttttgaggaaagaaagttaaatattttattcattgatttgagtaacaaataggaattgaaacatgctattacctcttttaagacagaaagaacaattttggtttgaagtgattaagttcatttagtcaaatacttgagccagtttggcccaaggtactgtggtgatttaaagtggaaagtggattaaaaatgtggcagaagaaacaagtttgggaacaatggatattggttccattttggacaccttgagtctgaaatgtcagcagaacatccctgtaaaagggttgcagaattagggctcagttgaaaagtctaggctagaaacgtaggctcacaggttatctgatagagatgatagttcaagtcataagtgtagttcatgacacttaggaaggaaaaagaaagcctggggcaaagacttaggcatacatctatatagatgggtttccaaagggaggaagcgttcctctgtttactgaagaagataccactattcaagataccactagacctagaataagaattatataaaatgataaagttcatttcgcctatggaggcttattgagaaacacctgtgtgaataaatgagctagtgctaaagtaatgtcacttctttccctaacccctgcaggcatgtcatggccctgggttagaacagtaggcagggagagcaaaggcatacagagccaattttgaacaattctttaagtgacatatatcataaccacccactctactgggctgaaatgaacaaagaatgacttaatatgtgtccctgcttagaacaaagcctggcttattcatggaatgtaaactgttattattgtcgtttttattattgtatactagatggagaggctagctaaaaatacatgaaaattagataacatgatttggtttttgtttttatttgatggctgtgtgtaaatagattgttaaatgagtgagcttatgttgaagaggataaggatttgtttagtttgggatattcagctaagtttcttaagacttgagctgattttgaagccgtaagtagggtttttagatgcgcagccttttttgtttgtttgtttgtttgtttgtttgttttttggccaggagggtaaaatacagagcattatgaggcaaagtaaaggcaaaagcaacagaaatgttccgtaagctgtttcttgtaaggttcatttttattctggaattaataatttgtcatatagcagaggggtgatgatgatgatgaaatcatagccagataatctgtcatggtaggaaggagggtggagatagtgcatgttccaatttaatgaaaattaactttattattacgtatttgctttttaagacttcatttatttcctgttagatgttgtgggcatcttttatgaatcagcgatttctctggagtttgttcaaagcccgagaagtaagcttcaggattgtgtgtattaggaagttctaaggagttagcgtttgccactttctgaagaatactttaaaaaaattctgtaagctttgtggaagagcgaatttatttcttcttcagagtagttacagttaagtagaggcatttctgtttcagagtcagccttgttagtaattgaaattttggggtaagaaatgtagacaacattgtgatacttggcagttccactttgttcacacttaaactctgggattgcagtgtgatgagatgctcatactaaggcattctggagctgagctcagctggtagaagttcatatctcatgttttgtgctcatatgaatggcaggtagaatggcttgttctatttaaattagttcatattctctctctctttgtctctctcattctcatagttgaattgttttaacttaaatgtgtgtatgatatgacttctctgtactttatgtacttttattaaaaattaattaatttagagacatagtctcactctgttgcctaggctggagtgcagtggtgtggtctgagctcactgtaatctctgcctcttgggctcaagtgatcctcctgcctcagcctcccaagtagctgggactacaggtgcacaccaccatgcccagctagtttcttaattttttttttagaaacaagatcttactatattgtccaggcttgttttgaactcctgggctcaagtaattctcctgccttggccccccaaagtgctgggattacagatgtgagccactacacttggccctgtagtcatatatttatgttatgtttgtagcacgtggttaggttttgttttcttttgcctgacagtttttgtcttcttactaaatcatgtctatttaatgtaatagttcatatatttggctttaaacctcccattttattatttacttctgcttgcactgcttattctgtattcccctttctctcttttcctgccttccttggattattttaagttactctgtatttccctctcttttagcttgccagttataatttctttcactattcatttagtgtttcctaaatgcatctttaacttgttatttgtatgatttcatggacagtgcaaggcctctataacacctgaattccatttgtccttctcttttgttttaatgttattatgttattgttgtgtattttagttctctgtatgtttaagatccatcagatgttatttcatactcactattcatttagttttagttatttaaattcattaatttattcatttagatttacccacgtatttcgtttgtgagttgctcttcattttttttttttctgcatctctgatctttcatctgggatcatttctttctgcctggagaatataatttagcatttagttaggtttgttggagatgaattttctcagcttttgtctgtctgaaaacatttgtatttcaccttcatttttagatttttgtggagagggtgctggatgtagaattctaggtaaacagtgtgttttttcaacactttacatatgttgttccatgtccactgaactctatcttttctagtaagaagtcaactgtcttatttttcttcttttgtgagtaatgtgcttacctcccgtctttggccacttttaagatttgttctttagttatggttgtcagaaatgtcactatgatgtgcctagttatggttttctttgtatttatcccgcttattgagcttgttgtatgtgtgggctgatcactttcatcacttttggagagttcttggcttggctgttaatcccttcaaatatttttttctgaattaaattccattagaatttagttcacttaggctcccttacatccttatctctctgatgggttcagaaaaactatagatttgtagcttgtctgccctgttttggttgttaggaaaacagtaatagtcctgataactttacattctgattagaggcagcactctctatattgaattcttaatttcattttattgaccttttcagttctgtaatttctttttatttctttctttcttttcttttttttttttttgagacggagtcttgctctgtcacccaggctggagtgcagtggcatgatcttggctcactgcaggttcatgccattctcctgtctcagcatcccaagtagctgggactacaggcgcctgccaccatgcccggctaattttcttattttttgtacgtttagtagtgacggggtttcatcgtgttagccaggatggtctcctgacctcgtgatccacccacctcggcctcccaaagtgctgggattacaggcttgagccaccgcacctggcctcttttttttttttttttttttttaaatagtttgcaggtctctgctgaagttctccatcttgtgtttttattcctttaacccactccagcatgtgtgttcccgtaggagttttgcttttatgtctgttttatcacctgatttgggagggtttcttttcatgttcttagttgtgattgaatgacaggtgttgtgtatgaaaaattatcgagataatctggatgatactgtcttctcaggatttacctttacttctggtaggtggttatgctggaggtactaacagtctcctaccacattacatagggattgaggtgatttaaaattaggctttagactctatgagttgaaatagtttaggtatacctttagttcttagatgtagccctttgaggctctgatccacagtttaaggggtttaccctccctcttggcaggccctcactccagtttttgtccccttagggcttgggtctgtcgaaagctatgctcatctcagcctcttcagcagtagcctttagaatctgccgatagctctaggccaaaaggagccccacataccagatttgtccctttggcttttctttctttttgcatcttggttcctcaattcctcattgccttgattgcctttacacagatattttgtgttttgtctagtttctttagttattctcagcgggagaattggtctaaaccatctactctatcattcctgaaagctgaattctctcaatgcctctttcatcatttctgttatttgtggaagtttgtctggtttttcatcacatgtagtctgctgtttggtgtcccatttgtatttctttggaaaattattgagtagccaaaagcaatcctcctgatttcagattgttctgttttcatatacacagtattcttttaagtttctttaggatttctgtaattgggatttctgcagttgggaattctaatgatattctaaaatttgtttctctctctctgtaaattttccggggaaatttttgctccagttgatagaacaatcattcttttagcttctaggtcttttcaaatgtctgtttgtggtgaccatgatgatatgatggtgtctatatatattcagtattgctggttgacatggatgcttttctttctttttttttttttttgagacagagtctcgctgtgttgcccaggctggagtgcagtggcaatatcttggctcactgcaaactctgcctcccgggttcacgcctttctcctgcctcagcctcctgagtagctgggactgcaggcgcctgccaccacgcccagctaattttttttttttttttttgagacagagtctcgctctgtcccccaggctggagtgcagtggtgccatctcagctcactgcaagctccgcctcccaggttcacgccattctcctgcctcagcctcccaagtagctgggactacaggcgcccgccaccatgcccggctaattttttgtatttttagtagagacggggtttcactgtgttagctaggatggtctcgatctcctgacctcgtgatccacctgtttcggcctcccaaagtgctgggattacaggtgtgagccaccacactgggccctgaaatggatgattttcaagcttgtgtgggttcctgttctaatatttcaggtatagatgaaagaagagaaagttttagatttgcaaccatttaacagtttgattgacattcctagattattggtttaacagaatgatctacattcctatatcattagtttggtggtttgcagggagtaggggcaagatatagccagatagctatgagacagggaggtttactgctaacgcattgtttgcaatgctgagattcatcagttgtggagctagctgtggcagcctcctgtatttttgtttttgtccccctacccccccccctttttttttgagacagtgtctcactgcacccaggctggagtgcattggtgggttctcggctcactgcaacctctgcctcttgggttcaagtgattctagtgcccaatagctgggattacaggtgtgcacaaccacacctggctaatttttgtatttttagtagagatggggttttgccatgttggccaggttggtcttcaactcctgacctcaagtcatccacgtgccttggcctcgcaaagtactgggattataggtgtgagccactgcacctggtgtgtttctgtccctcatctctaatcctcaacatgagtgctgaaccagatgctttgccagccttttttcttggaggtatcatgggtccgtccacatatgcttgtcgctattctgtgatttccagtggaggtacagattttcccccttggtgtttttatttattaattttttaaaaatttgttcagttattttagtggatattaagataaggtgttggtgggcattggttaaatgcatgagcttagttttgccatcttggactgagaatctacactgggtattttgttgttgttctcatttggtttagtttgatgtctgatccaattaaaaagaatagtgtttttttttaacttttatgtacatttagattgaaattctgcaatcactgaaggactgtgctaggctagttagctcctgactgatgtaaaacctttgatagagtggggctttttttttttttttggagacagggtctcactctcacctaggctggagtgcaatggggtaatcacaggttactgcagcctcgacctcttgggttcaaatgatcctccccccttcagcctcccaagtagctgggactacagtcatgcgtcaccatgggctaatttttgtattttttttttttttttttgtagagacagggttttgctatgttgcccagctggtcttaaactcctgggcttaagcgatcctcccttcttggcctcccaaagtgctgggattataggcatgagccactgcgcacagccgagtaggggcattttttattcaacagacattttcatgattgccagctgcgttttggggcagtgccagattttgggagcacagatgtcagcacgttctttgatcttatatacctgttattgaggcagagatacctttctctgaggccaagagactttttttttttaaagagagagaaacagtgtttgatcaaagtttttgttttttaacccattagttagattgttgaatatcaattaatatataaacattgataatagtttttatatctatagaaaatattccagttaaaatcttatctataatttcagttgaattactcatttttatagtaaatttctgtttattctctgactagatgattatatcaattaagggtttatggtttatatatttttatatatatacacatacgtatatatatacgcacacacgcacatataatagatataatttacccatgttacacatatttagaaagtaggatagtatggattttatggcatttttattttttaatttgttaaataaggaattcagagtttagtaaggtaggtaggacatgagacagaaaagtagaggcattatatattcatttttacttaaaggaagaagagttagcagtctgcttccaccttaaagctagagtttgctagttgggaaataatgctttggaagtggtttgacagattgagtatagtataaggaattgggaaaaagcaggcaactgtggccaaaaagtagattggaaaggaaaatggctagcttcaatatgttggcatggggaaaacaaggttatatctgttagaggcataaaatactctgtacagagagttggttgtcttcattttatatccaacaagaatagtacaatttagggaaagttattaaattgaacctttcagactaatgctttgccatgatgtaggttaatttccctatatgtcgttcatccttgctcaaatatgtattttatttgtaatattataaagttgatataaaaaatacacttgatgccagattttcagtttttaatacagtggctttcacacttgttcaggtgttagaacatctggaagtagtggtatactttgagagatatcatgaactatattttaattacatgaaacaaatgaagtgtaattttactagctgtagatataactcatgtgagtgtaactcaactcggtagaaatatttaaggagcatttgttatgtatcataaatgcataatttcatgatgaaagtgaatcatggaagagctagaagaaaatagaaaagaggtttttaaaaagccttatcaatagtgtatacagtagtccccccttatccatgggagatacattccaagatcctagtatacgccttgaaaccatggatagtatcaaatctatataccagtttttttccctgtacatacatatggcaaagtttaatttataaattaggtacagtaagatattaataataactagaacagttatgacatattgtcataaaagttaagtgaatgttctgtctctctgtctcacagattatctaaatattttcatatcatggttgactatgggtaactgaaactgtagaaagtgaaaccgtggaaagcaaaactgtggataaggagggactgctgtaatatcttttaagattatatcttcagtaggggctggttgccttagccattggcagcatgctgaagtgattctttttaaaaatatttttagagtcaggatctcactctgtaacccaggctggagtgcagtggcatgatcatagctaacggtagccttcaactcctgggctcaagcctcctgagtagcttggactacaggtgggtgctaccacacctggctaattttaaaaatttgtatagagacagagtcttgctatgttgcccaggctggtctggaactcctggcctcaagagatcttcctgccttggcctcccaaagtgcaggcatgaaccatcgtgcctggccctaagcgattctttatgtgtagttactactttcagggcatcattacacatctactgagagaaaatttgtggttctggggcctggaaatctgaattttgagaagcatctgatggattttgtattcataaagtttgagaaacattttctaagtgctgattgaaaagaacaggatattgcttcagaatttaaaagaaacagtgtttgagaatgaactcctcctccagggaaaaatgtaatttatgtatgatggggtagttgctatttattcacttagatgttttttgtttgtttgtttgtttgtttttttgagacagagtctcactccatcacccaggctggagtgcagtgctgccatcacagcttactgcagccttgaccttgtgggctgagttgattgtcccatctcagcctctcaatggctgggactaccatgcttggctaattttttgtatttatttgtagagacagggttttgccatgttgcccaggctgggctcaaacttctaggctcaaatgatcggcccaccgtggcttcccagattgctgggattacaggtgtaagccaccacacctggcccacttttgttttaagaaatgtctttataactgaatattgaaaacaattgccgttctctgaaagtcttttagttgtttttccatagaaatgatcatactatatctgatggcttttaatttaattttgtttgtttgtttgtttgtttgttttttgagatggagtttcactcttgtcacccaggctgaagtgcaatgggccgatcttggcccactgcaacctccgcctcccaggttcaagcgattctcctgcctcagcctcctgagtagttgggattacaggcatgtgccactacactcagctaatttttgtatttttagtagagacagggtttcaccattttgaacaggctggtcttgaactcctgacctcaggtgatctgcctgcctcggcttcccaaagtgctgggattacaggtgtgagccaccgtgcccagccagcttttaattttttttttttaactgtgaaatgtcattagaatttggattgtatttcattaatgtaatatctggaagattcaaagttataatttttaaaagttttaattttgctttattaactgactcaactgttggacggaagcaggaacataaatgaaaaggtcatctgaaagtctcatgtatacaagctttttctaactctccaaaacaaggtgaatttcagacaaattcagtaaacctttattgagtacatgttgcatgctctatgttgggaccatgaggatgattaaaacttacatcctgtcctggtaaagttcacacttgtgggaatgagatagggtaggaatacatgtaaacaagcgatttgtgctttgcctaaatttaatgaatttaaaaggttattaaataaagtgaccatcataatacatgaagaaaaagtgtgtgtgtgcttgcgtgcatggaggtggggttgtggtggtgatggtcatgtttcatacttaggcccgttgtagtagcctaggtagtttacagaggtaaattggattagcatgatggcagtgtagagaagtacatggaatagaaagatatttagatgataaagtagaatttggtgatggattggatatggtggtgagggagagggacatgtcaaagatgattcctaaggttctttaggatttgcatagcaggatgatgggtgctgatgtcttttacggagaaagaactaagtttgggggacaagaagaacatgcgtttaattttggacattatgaatttgatacacctttgtgatatccaggggcagcattacagtctggagtgtgatggaagacatgggctgtagatttgtgagtcatatgcttagaatgtggttgaattgagaaagatgggttattataagacagagaagtgagcggagaagtaggaggaaaactaggagaaggttgtatcacaggaaccaaggaggagagtatctgattctgctggcagaattaagtatgctgatgattggagagtcttttgcatttacctgtcagtcactgttgaccttactgacagctggagatggaatttggaagcaggttgagggacaagtgggaagggaggaaatgaagactgaaaagttccagaaatttagccatgatggggatgactgaatgtagtggttgaggtctcatgagttgggtgtgtgtgtgtgtctgtttaatggatgagattctggagcgtatttaaaaatggaaggctctatttgagagggatagtttaagtatgcaaggaaaatgggataactgacagtgtaagtttcctgggaaggttgggagaacacggggttttgagcacaagtagaaagatttgcattcgacccattgtaggagagagaactctcctttaacgagagggaaggaacataagaacaggtgaatattattgttaatgaggcagtgaggccttttgctgtacgtgataagcaggaaatggttttcaggagtgttgaggaattggttgaccagagaggtaggattactattaccagaactaatatgagaatgtaccatactaggagatttaacaggattgtaaattatatgggaatagtattgttttcagtgccttttccccctcatctgccaggcctcagtgagcccattggagattgtagattcccagtaagtatttaccctactctagaatcttaaatgaaaaatgcataaacagtagctactcttgtctgacttgaattttgtggactaatgatagaattaataagtgaaggaggtctcttactataacagtgtttaattcaccatttcaacaaatctctccctgcagcctactaagctttttctttaattaagtacctgatttacacagcagattttactcatttgaggactcaagtcatgtctaaacagataaaggtatcagctcaggcatagttcaggtaccttgtaaatgcaatcagagttgttctgcagggtaattcagttttagacatccatttctaaaaacgggttctgtctgaaaatggaggccttaataaccaatttctcgttattcagaggccagttatctagtttatttatcaagattaggcagtcaccttgtttttcactcctttctaatctctctgactgttttgttgttttaaactcatgagtaagataaggagaagaaaaacagagaatgtacataaattaatggctaaaatgaagtgttcctttgcatgtttctttttcttatgctttatttctgtgactcatacggagctgttagaagtgacttcatataatattatacagtgtaataaaatgggttttcgatgtgtgaggataccctcatgttatttagattatggacacaattaacaattccagacagaattattttctcatgtttgaagtagtataggcacatggccctttatgggaggggggaagctcttctctgtgtgcccacttttcacatccctctccagcatgactctcccctttctgtcagtcttaccccaggagtccctggcctccttcctctccttgacactgtttgctttgcaagcatatgaaatactggcaccctatgaccagggtagactacaaccagggttggggtgcaggagccagatggagaaattcaaattatgatcatgagaacatgttcctctaggtagtggccatacttttatctctatatccttaggacgtaacacagtgcctggcatataatgtgtctccagaaatattttgtttttgaattaaagactatttcaaaattacagagtcataggaggaatcatttaatttatttttctgcttttataggtgaaaaaagtgaggcttagattcatagcacctatttaagttcctctgacatgaccagttatgctttagaccatacaaagaagtaagtgaatatgatatacaattccagccttctagaagtccaaagttaaatagaacgtccagcagccttttatctagcagggatttttgtgggggcgggaaagggacagagggaaggatgtgatggtggtgctttgttttggttgtggtgcctgtgttgcttgatactgtgttatggcaggtacagagttgcataatatagcttttgcccttaaggaacttgtctaatgtaacctgagacaacatattaagaatcagtgtgtctcaaagcagtatatgattaaatgccagatgagtggtgcacttttatgtatgccaactttataaaatgaaaaaatgctaatgatccatcacgaggcagacatgcactttcagttgctattctgaaagtggaaacagattggacttgggggaactctgcatctagaagtacaagttgatgattattgtccatttgatagagacactggaagggtgtcagtgtaaacactggccatgtgaagattgagcctgttgatggtttcttttgtatcataggatgccacgtcaccaactagggaattctgcccaatcagttgagccaaatagtgctgtcctattgtaaaattgtttaatctgtgtgcttgtgtgtgtgcttgtcagaatttgtgaatcatagaattgttttaactggaagaagacccccaagatcatctgcttcaaccccttccttcctctcttttccagagaggttgcactttacttgagctgtgactaggattatgccacattcttttgtaagttgtaacctatttttgtctgttttgaatttcctttttttgctaagctttagcacaaagttcaccaggttttgaatgaatgtctcatatttgcaataatttagggaacagttgagcatggaaggagagaatagaaatatggggagggagatcgtgaaatgatgtttccagtggaattaatagaagtacaaaggaccaagaattaaggtgcggctcagatctcccttttgtctgcttttggtttgtgatggtataacattgcctgcaaacagccacgatgaatattttcatttttattaatagcaatatgggggcatgaatagattctgtgatatttttagatacgcagagactgtgaagaaaatgacatttagtatataatttttaccctgctcttaaggtgtttgtaatctagttgagaggtcctaccttcaaaaggtttacgatctgattggagactgaaggacctaaagaagttaagtaacaatgtcatatctctgtcctttctgctaaatgaatgctacttactatttttccagtgcctagaagagtgccaggcccatagttgattttcagtaagtattggttgtatagataaatagaaggtactgacagtaagcatgagaggacctctgagtggtgtggcatttggagaaggcctgggatcttgtacagtgcaaagcttaagtaacttcattctaagtttgtatttccaactcccccaacctcagcatgttctccccacccacctcctcacaccccaaagcagtccctgtcttttgttaactgatttttttctttggaagcaagcctgatctttctcacatttattttgctactgctcaggctaccttcttttcttatctctacctttcctctttctcacaacattgctgttcctcttcaaggatttagaaggatcatgttttggtttataagacaactgtgttttcttaggtccttcttctctccagggattattgtaggaggtaaggcactttctgtggaagaactgagttatcagaaaaagttcagaaacatattctatgattatttagaggaaaactgtaggatagtgatatcttataataacatagcaatttttttaaattaattaatttatttattttgagacagagtctctctctctggcacaggctggagtgtagtgacatgatctcagctccccagaacctctgcctctcaggttctagtgattctcctgcctcagcctcccgagtagctgggattacaggtgcccgccaccacgcctggctaatttttgtatttctagtagagatggggttttgccatgttggccaggctggtcttgaactcctgacctcaggtgatccactcacctcggcctcccaaagtgctgggataacaggcatgagccaccgttttcaggttgtcataactacattctaattgactgcatatttttaaacacaaattaaactagttatgttctccaccctactcagttttggcagtataaaggcctgtttcacagagaagaacacataaacaagtaagtacaaggaagcttgtgtgaatgaagttctgctgtacagctcagtgactttctctgatttaagatgtagctcttggcaatttcaaatagtttgtgttctctgaaggagaagtccagtctatttaactgtgtttagcaaaaactaattatgattctctgatgggaaatagattctcagactcatttattcattcaacaagcatttattgagcagctatgtatgaggcactgtgctaggtaacgggagaaataagttaccagtctaacaaatggcatatcatacgtaaaaataatactgctgaggagaaggtgatatatgctgtaaaaggggtgcagagtgctttgggttttctaaaaatgagaaggttacttccatgaagcaactcagtgtaagctttatgggatgatagaatttgatagatcttgaaggctgggtacatggttcctctgtccattgcgcaggatgttggccctggcttagcagtggagacagacctatggcgatgggaagcgggagaggaagtataatgagcaaacatccagaagtgggaaagcattggtgatatgggcaacagaaagtaatttacttggaggtttagggtggtgatgtgaagtggcacaagaaagggatagaaaagaagcgtccttgatctgacagtggtgtatactgtgaattggaagagtgggttcagtctaggctgtttacccaagttggtgtttcatggaccattgttcttctaatctagtagtttaatagttttatattaggggaggggaaagtgttccctgttcaagtaagctagagaatccctgcaggagaagcagggagaaggatattgacaatgtagaatgctttctgtgatatactgtattcagttgtgttgccgtattaaacacagtggatgtttgaatgttctgtagatttttatcacctgaaatttgttggttttcatgctgatgtcttcaaggatgattcaggaggagcagtataggtggctggtctagtttcatttcccagccccagtccacaaagggctctgtttatctaaaacaatggcagtgtttcctaccgtcctgctaaataagaggtctaacacacagtaaagtgttcttaaaagattttagggacactgaggtgtagggtgtggcacgggcaaccgttggttgcacagatacagtagatgctctatgtttctattgagttaagatacagttagctgtattttccttgtatctttctgcagatctcttccttcatgcctcctctagaaacactagcagcgctgggtgtttctaaggtcttggggaccttaggcaagctggttaacctctctgtgctttagttttctcatgtgtaaagcactgtgtgctggagatttttaaaaagtgtgttgatatagtaagtcatttaatctgtggttatatacctagtaaatgacaagcaggaatttgaactcaggccaggctcttaaccagcttgctgcattacgaaatactaaacagtgtggttttccctcctggaattccctttctttctaagtgcattatctcttataccctttgtttagtcagactacttcctctatttcaaagagaaaggaaagaagctcttttttaattgttcagagttgtgtatggcaaagagaatgcccaaatagattttgttttggaatcttattgttactggttgtttactgccccacatccttagctccaaagagcagagaggatttactgtgaagtttggcatgtattgtaggctattatgccatgtaataggcccaaaattgtggccctaggaatacaaattatgttaagacatttaaggcaatttctagaaatctttttcccttgaaaagagtaccaataatttttctcgctaatggccaaaattactcaaatcttacttttggacttttaaaatatatttttactgcgttatagttgaaatgtaggtatggttgaaacgtaaatctagatcttaagtgtactattcaatcaattttgctgttggtactattcaatcaaataggccagtgggttttctttgtatttaatcaattagtatgggaaaatatttttattttaaataaatgtctctctttattttttgtgtatttctaaattcatatgtattttcaactcattttttcactcggatacatagtttaacaacagcctattggaagtactcttttatatgagtttctgctatacttgaatagtttcccttcagaaatgaactgtttgtgttggagctacatagagtgaataaatttcctgggcggaaacgataataaaatattcaggaagttattaggaaatgagaacttgtgttcttgttcagtcagataagcttctgagacctttgcatatatcaaagcagattgtattagaggaaggaatgagagatttggcaactttcttctaatagtgatagggaccttggtcaatagaatgatggaatatatgatgtataaatgaaagaaaaattctcaaagcaaagttgtttgagaattgttttttctctctctttttgtttgtcagggaagaaaagtgagagctttctgaagttaggttatgtaaataacccagtagggaaaactgttcctgggggagacctacaaataattgatggcaataagcttcaggagtatgaaagaagtggatgagtatgcctttcccccattgattccactcacattttttcttctctgtgctttgctctcttgttgccattagacagtttctatctgtccttaattttagccagtttgttctaaagtaactgtgaacactgtaactctctagccagtgcctttcttttattgaatggaattggtgtactagttgttttatttaacaaacagagtttataggcttgttttttcctcaacatgtcttcatggcagagacaatttacccttaagttggtgagccctggatcccctcacttgcatagacctcttctaggatctgggagaggctctagcagtgtagtgtgtttgttagttacatatttttgtaacatttgcaaaattgaaaaatttttttccatttttttttttcttcaaaaaggccctcaaattatatatgcttcaaatttcacaaaactcaggtcagccttggttcatggtagaggttgggtgttgatttctaattgtggccgaggtagatttggttagtggattaaaggacatgaggaaggaagcattagtgaggaagttgaaccattgactggtgtgtatagtggccagggatctctttctgagtgtcaggggtcatctcttctccctgcaaacatgggccagaaagaggcgggagaagttgggtaggactggaagaaggacagtggagggaaaggtgtgctgcagccaaggtggtaaacaaattaaggtgttctccttagatttcaaggatgcatttgcaaatagcgttttcaatagcattttaaaataactgaagagtcatttcaagataatatatttcatcttgataataatacattttaagaattttagaattattgaaaaatttgaaaagtcaatttcataattaactgattgacttgagattaaagtctttatcttattaattagaatatattgctgaacacataaaacacagacatgttcatttttgaagggcgttgctgtaacttgggttttgctagcttcttggtttggtagatgtttcatctctctcccctttttctcattgtctcacctgtatttttttctaccttttcatttcatgttccctttactttgggattcaaactcctcttagacttctcaggattttgaatgactggactatagataatcacattttaaaactgcattttaatattctgttctctttaaagaaaattaggtactctgcatggcctggggacaaatttacagttaaatagaagtataatgttctgagggccaattgtaactaccctgtggttaactggctcaggttcaaatacagttaaaattattttacttttcctaaaattccttctaattggactaacttatcagggttgataaaaacatttccagaacgtagtatggatctgccacctggtggtgaaatattacagcaagtactaagtgttttgtttttttttttctgagacaaggactcactgtcacccagactggagtgcagtagcaccatcacagctcactgtagcctcgacctcctggactcaagcaatcttcccaccttagcccccagagtagctgggaccataggtgcatgccaccacacctggctaatttttaaagtttttgtagagatagggtctcactatgttgcccaggctggtcttgagctcctgtctcagcctcccaaagtgctggcattacaggtatgagccaccacacccagccaaatactagtatttttttttttttttttgagatggagtcttgctctgtcacccaggcttgagtgcagtagcccaattttggctcactgcaacctccgcactccctgctccgggcccaagtgattctcctgcctcagcctcccgagtagctgggactacaggcatgcaccactgcatccagctaattattgtatttttagtagagatggggttttgccacattggccggactggtctcgagctcctgacctcaggtgatctgcccaactcggcctcccagagtgctgggattacaggcatgagccgccacgcccagcctaaatacttgataagaatttaataatggattcttgcctttgtggccataatatttagagtcgagtctacttaagctctttagatatgtaacattttcctcccctaagtttttttcactgagaaaatgttacttaaatgcgatagagtaggtaaattttgactgatgtgtttctgtctaccgcatcgtaatataagatgacatttgtagaattactgagctgaaataaattctgcacacattgagaatgtactctccttaaatttgaagatgagcttttgagaagagaagattgctgttaatttttctaaaatttcaatgtggatagtcattgattcacagaaaaaacagtaatatgaagttcacagaacaaagaaaaaacagtaagatgaagttcacagaacaaaggatttttttttttggaaagaaagcattttgtttattcacttaaaaatattagcaggcatattaaaactacttttagcaaatagactaacagttttatcaccctcaaatgaattattaatacatatcagtattttatatatgggcactgtgttaggtatacatgataaaatagtgaaaataaaaatgtctcttgtcctcctggagtttataatctagctagaatctgtaatctaacataatgttaagggccataaaggagaagtgcataatagggagagttcaccctggctagtgtatcagagaaagcttccctaaggaagtgacgtttcagctgagatctgacagatacagaccctggctaaaatgtgtgtctgtatccctttaaagtgggaaggagagtggcaagtatgaggaattgaaaataacagagtgcctggaatgtagtgagagaagggactgtggtgtgaatgaaaacaggaaagacggtaggagcaaataattcagggccttgttggatgtgtatcaaggactttggacttcatcatgagagtaatggaaagctgttgaattgtgtagttaagcagtgtcagatcagattaatgagaaatgaattggagcagggcaaaactgaaaagaggtcaggcagttggttagaaagcaattgtggtagttgtggcttggactagagagtgtaaatgggcgtgatgagaggctgccatatttcaaatatatttgaggtagaatagacaagacttggtgattgaatgggatggaagggggagaggtagagggagatgccaaggatgggcccaaatttctggcattcatacattcaataaatatataaatataaaacatatatatatataaaacacagtttggtccttaaagatagaaagtcgagtagccccagcgttcagttcacaatacattatcattggacagtgcaagatatctcttattttgtattttttactctgccttcatctgccacactcagtcccatttcccttgtctccttaggcttctactctaatatgttttatatatgtttttgaatatgcattaaatacataaaatatgaaatgttgttttgtgtgtttttaacttgtgatactgtgctgtacatgttattttcttcgttattctgccttatgttccttattactagctgtatggccataggtaagttatataatgatttttctgtttcctcatctgtaaagtgaggataacaatagtattaacagtacttagattatagataaacttttttaatcctcccaacaagtattcaggtgtctgcctcaagggatcctcctgccttagcttcccaaaacactgggattacaggcatgaggcactatgcctggcctgtttttcatttattttttattttatttattttcattgacaaataaaaattgaatatatttattgtggacaacataataatgttttaaaatatatagggattgtggaatggctaaattgagctaattaacatatgtattacctcatatacttaacgtttttctgtagtgagaatggttaaaatctaccctagaacttaaagtataattaaaaaaaaaatctcccagcgattttcaagaatataatacattgttataatattaactacactaaccttattgtacaatagacctcttgaacttattcctcctatctaactgaaattttttatccttttgctaacatcacccaaatccccacccttcaacctctggtaaccaccattctgctgtctgcatttatgaattctacatttttagattacacatttaagtgacatcatgcagtatttgtttttctatacctggcttattgtacttaaaatgtcctccaggttcatctttattgtcacaaatgggaagatttcctcctttttaaaggctgaatagtattccattgtgtatatataccattttttcctttatccattcatctgttgatggacactgggtaaattccacgtcttggctattgtgaataatgctgtagtgagtatggaggtgaagatatctctttgatatacttatttcatttcctttggatatatacccagtggtgggattgctggatcatagggaagttttatttttcattttttgaggaactttcatattgttttccacaatggctatactgtccatttatgtttcaattttacctttttctttttgtgtgtgtgtgtgtgtttaatgtgtgtgtgtttaatgtgtgtgtgtgttcagtggccccaggtcttctacagtttcttctttaatagttttaggtttcatctttaggtaataaatatttattcaacaactgccttgttctaggcattggatgtaaaaccgtgaaccaggtatacaggggccttagctgaccccatggagaaacaaagcaactggatggatagtggtagtgatttaggaaatatggatgatgaggaagtttggggcagaagtgggggttggatagagtaaagatcattagttcagttaaaaaagtttttttttaaactacagagggcccttatgccagctttttgtagtcaagccctccctccactcctaactcttggcattcactgatctattcaccatccctttcccttttccgggcataaaatatgtaatcttttggggctggcttctttcaccaagcataatgcctttatcacacaacaacatagatgaatctcaatgttgtatgaaagtttgttccttttcatcactgagtagtattccattgtatgaatgtaccatagcttatccattcacctggtgaatgacaactgggttgccagcagttcgtagggattatgaataaggcagctataaacatttgggtttataacgttaggtttttgcgtcaacatgttttcatttctctagggcatatatctcagagtaagattgctgggtcatatggtaagtgtttaactttatgagatactgctcagctgttcctcagaatggctgtaactttaaaattcccaccaacagtgtatgggagttatagttgattggcatcctcaccagtgttaggtattctcagttttgttttgttttagccattctattaggtattttagtgatgtctcatagttttaaattgcatttccctaatgactgatgatgttgagcatctttttctgtgcaacttgccctttttggtgaagtgtgtatgcaaatcttttgcccattaagaaaattggggttgttttcttgttgttgagttttgaattctttatatattttttatacaatttattttgttaataatttgcaaatattttctcccagtctgtctttttatactttcaatgtctttcacagcaaaagtttgaaatttagtgaggttcgacttgccagtttttttcttttatgaattatgtttttagtgttatgtctaagaactctgtgtctaagccaggtttacaaagacttttctcctttatttcttctaggaattttatagttttacatttgacatttagatttatgatccatattgagttaatttttacataaagtcaagattttcttttgcatatggatatccagttgttccaaccttgtttgttgaaaagactatcctttttccagtgaattgcattaggacttatgtcagaaatcagttgaccatagttgtgtgggtctacttctgtgttctctgtttggttccattgatctatatatctgtccttttgcctatcccacattgtcttgattgctgtagctttatagtaagttttcaagttgggtagtttgaatccttcaattttgtttttcttttctgaaattgtttagctattctactttctttctttttccctgtaagtttgtcagtttatctttatgaaaattttggttgagattatgactggaattgtattaagttcatagactaatttaggaagaatgggcatcttagctatcatgagtctttcaatccatgaatatagtatgtctttttttttttttttttgagatggagtctcactctgtcacccaggctggagtgcagcagtggcacaatctctgctcactgcaacctctgcatcctgagttctaactgcctgtttctagatttctttttttttttttttttgagttggagtctctgttgcctaggctggagtgcagtggcgcgatcttgattcacacgattctcctgcctcagcctcctgagtagctaggattacaggcacatgccacccatgcctggctaatttttgtatttttagtagagatggggtttcaccatgttggccaggctggtctcgaactcctgatctcatgtgattcacctgcctcgacctcccaaaatgctgggattacatgcgtgagccaccgcgcctagccagaaacaattttatttgttccttttcatttgtatgtcttctgttaattttctttgccttattacactggataggattttcagtacagcaaaaaatggtgaatgtggacatctttgccttgtttctgattttagggagaaagcactctgtcttttaccattaagtatgatgttagctttagtttttttgtagattctcttttttgagttaaactcccattctgttcctagtttctgagagttttttaaaatcatgaatggtagttgaattttgtcaaatacatttctgcatctgttgataagatcatgtggttttcctttatagtctgtcattatggtggcttacagtgagtggtttctgaatgttgagcaatcttatattaggataaacctcaacttggtagtggcttaatattccttttatttattatatgtaactggatttgatttgctaatgctgcattgaagatcatgccatctttgttcatgaggaatattggtttgtagttttcttgtactgtctttgtctggttttagtgtcagagtaatgctagctgcataaaatgagttgggacatgttccttccttttttattttctggaaaagatcatgtggaatgttatttcttctttaactgtttagtagaatttaatactgagatgaaatgggtcttctacaagataaatttactttcataatcagaataatgtaattgtagaaacttaaactatagaaatgaatgatgagaatatcatgtctcacaattcagatgattattaatattttggaattctttttctagttttttcctctgtatacataattgtatatttttgaattgcatataaatgtgggtatatatttaaaacaaaatttgtgattatactacaaataccattttatttctggacccagtgtggtttctaattttgttgtatggatatgccataattttacataaacattcttctaatgttgaacatttaagtgtgataaatgtcttttatgtgtttttttcctgataatttatttgacttatttctagaaaagaatttgacatatgtaaggctgctcacacacattgctaaattgctttctagaaagtatatatacgtttttactctaaaataggtaccttaaaaagtatgtttatatcttcagatatgtaaagacatataaaatatatagtaatatatatctgactatgcatattcatatttttttttaaaggaaggagtggaagtgaagagaatatatatcaaggggttagcaagattaagggaaagactaaagaaatttttctatgagacatctttgtagatcagggcaaagattcagtggaaaggaagatattgaaccaggagcaaaaatgcagagagttgtttgaaatgatgaaatatggtctggatgaaaatgtagggaaaaatgatatcaaggagagaaatgcaggaaacaaaggaactgtgcttcttttaggttgagacctgaaatagctgatatttgaccagtttttacctaaaaacatgtagtttcaaacacttttacctgatacttgtgatggaaagtaaagaggaaagatgcaaaataaattttgaagtgcaaagaagagaaattcaatttatagaaaagggattgcattttcccaaataggaggcaaggctatcttaatagaatgggtcagggtaaaaagagtgaaaaagttttgtataaatagtgtggggaatgtacagttatagtcacagacaaagatgagttaaggggcagtagtctcaacacaaaatgaaggctaggattaaaggagagggaaaggactgaagaggatggggacattcaaaagagagcattttagttaattttggtaaattaattgggcgtgaaatagagaagatgaagtaagagagagtaaagtcttgaggctagaaaaactcctaagaagaaggaagatgcttcctaagaagattcagaaagagtaaggaaggaaaagtgttagattttaatttgttgagcttgagttgacttgaaggaagagattcagatttgtgcatcattatggttgatagttgcagttctgagaatgaaaaagctctttgaggaaacaaatacagacaaaaggtcattttatttttattggttagtaattcaacaatgtcagatattttcaaaccacttatctttctgtctcctgattataatgatgagtgaacactagatttttatgtttgattaaaagcaatttatttttgtctccctacccccttttcagaagtgggaaatttcacttctttttaagaccggacataagtatgtgtagtaaagaataagaataggaggatagattagaattaattagttcagtgatttgtatgtacctgataaagtattctaataattgtttttggtatcttagagaaaaaatatctcctaggcaatatttttttttctgcatataaatgaaaatgttttgacatatgatataggactagtgaaccaataacttctcctgggcatctacctcaccatgtagaaaatggaatgaagactttggcaagcagtcaaataaaaatatgcaatgcatggaaaataacaaatgcgttaaaaagataatattgcccatattgagggaagtacaagttaaaacaacttacaccattttttttttttttgctccttaacttggtcaacatttaaaggcttcccagtgttgacaaagaaaagggaaaatgtctttctcatatactattgaagggaatatagattgatacagccttttttgtaggtggtgatatttatcaaaatttaaaatatacattattttttacttagtaattctgcttctagaaatctatcctacagatacctctcaagtgtgcaaaaagttatgggcacagagatgttccttgaagcattgtttataatagcaacaaattggaaatgacttaaacactgaccgttgggtatagccctcctacataggatgaccatatgtctaaatttgcttgggacggacccagtttacaccagcataattatttagagcattttattttactctcagatgtgtcctggtttggaagataatttacctgtttggtttatgttcacactaatagcatggagaactatgtagctgttcaaaataatgagatagaactataggaattgatatagaaatatattcaagatacattgttatgtgagagaaacaagttgcataacaatatatattattccatttattttattttatttttatttatttaagagggagtcttgctctgtcgctcaggttggagtgcagtagcgcaatcttggctcactgtggcctccgtctcctgggttcatgggattctcctgcctcagcctcctgagtagctggtactacaggcgcatgctgccaagcctattactccatgcatttaaaaaagtaaaatctctaagctctctgcatgtgagtgagagagaatgagagacaggagttaaaaatgtctggaaggattcatactaatttgttaatatgataatctctgcttaaagatggcagcccaatgaataggcatatattgaattttttaaaatataaaagcagcaataacaaaaaggtgggaactgttgattgccagcagatgctataatttttaaccagagagcattaataaacaactattacaattcttaacataaaattataagtattatactctgtcctgtataaataactattgtattagaaagaatactaatggaaaatttaaaaattatcactatcattccactattaccaatcattttacatgttacctcctgttcctcgtatctttatgtacataattcttacatcgttataatcagagcatatagtttcatattattttaaattacaccctatagcatattttttgttacaatatagtatctagcatttttagatgttttatatgtgctaagtactgtgttaaatggtttgcatgtgtaatagacttaatcctcccaattgcgttattgaggcagttactattatcccaatcttatagatgagtaaactgagaataagtaatttgcccaaggccacacagatacagcaaatggcagaactgggatttgaactcaggcagcctgactcttgaacccacgctcttatccactactattactacctccctttacaattttttagtgactgtgtaataacagcataccataatttacttagccgttttcctggttgtatatttaatttgtaggctttaaaatctgaacctcaaaagtttttattaaacaagctgatgcctactatgtgcaggaacctatttgaggtactatggacattggtacacatatgcagttatggtctagtattgttttatcttgccttatgtattacattcctgaaaagctatatacgtttgaggtgaaaatttgtttatacaaactttttttttccaatcgggtttcattattttaaagatacattattccagaaaaacaaatacttaaaaactagaaaatatttaataaaaattagcagtgagctcagcactgtttggtgcctttaagggttctgcttttgcgcatagtgaactgtattcgttttgttgttgttattgtttgtttgtttgtttgtttttctgagacagggtctcactctgtgtcccagggtggagtgtggtggcatgatcactacttgctgcaaccttgacctccctgggctcaggtgatcttcccaccacagcctcctgtggagctggaactgcaggcatacaccaccacacctggctaattttacacttttttttttttttttttgcagagactaaatggattctgtaggatattgtgggaaagactgggaatctttcccagtagaggtctcgctatgttgcccaggctggtctcaaattcctggactcaagtgatcctcccacctcagcctcccaaagtgctggggttaaggcataagccaccgtgcctggcctgtgagctgtattctttcatgtgacagttgcaagaaaaattacttaaataaatgcatgccaggatttgtgattaccgaataaaagtacataaaattgaactctctattcagatggagaaattacatgggtaatctccaaatcttttgtttacctttagaatatttatttatgcttatattgaaataaggtgaaattacaacttcagggttcatacagagaagtcacatttgtaactcaggtggatttattagatagcgttttaactacttctgttccctggattagtcacctagtcaccactcttgtctttgtgagatagagatatcaatttaatagaggaacctaagtactacacaagtgtcagctgctgtagttgattaagggggataattaagagctttattttaaagctcacctgctgaatatctagatacctgttatataagagcaaaacacatggttatctaacaaataacttataatccactttacttaattatggcattagtttttgatttgctgatccttctattaaaattttatattaaatacagcatttagttgatgagtttcattgaaaatgttcatttttaaattgatattgaatgtagttggtgtttggttactcagtgtatcttctgtacctggtctttttcagtgttcttatatttatatttcaagtcagtcataaagattttcacacataaataagattactattttgaaattgaaatgataaaataccataaagtgcccagctttagaattttaaattattttatgtcataattattgctttttaataagctttattttttagatcagttttagatttacagaaaattacagttagtgcagagttcccatatactccacacccagtatctcccattgttaacatcttatattaaaatgatacatttgttacaattagtaaacctatattgatatattaactgaagtctatactttattcagattttctcagtttttagtttttaacctaatgtcctttttttctgttccagaatcccatccagcataccatattacatttaattgttatgtcttcttgggctctcttggctgtgatagtttctcagactttccttatttttgatgaccttgatagttttaaggagtactggtcaggtattttatagaatgtttctctgttaggatttgtctgatgtttttctcaggattagactggggcttatggttttggaaggatgaccacagaggtaaagtgccatcacaccatttcaaggcattgatacataatatcaacatgatgtatcactattaacattgaccttgatcacctggctgagattgtgtttgtcaagttctccctggtaaagtcacctacctttttccatactgtactcttttgagaagaaagtcaccatgggcagcctgcacttcaggagtggggaattatgttctccctcgtagagggtggtgtttctatgtgaattatttggaattcttctgcatggggtatttgtcttttttctccatttaaaaatctttcaactgtatattatgaactcatgggtatttattttgtactttggattataatccagtaatcctttattttgttgcttaaattgtttcagctttgaccatgggaagttcctttttttttttttctttttggatacaaggtcgtgctctgtcacccaggctggagtgcagtgacatgcttacagctcactgcaacctctgcctcccaggctcaggtgatcctcccacctcaacctcccaagtagctgggaccacaggcgtgcactaccaaccacgcctggctaattttttgtattttttgtagagacagggtttcgccatgcttccctggctggtctcgaactcctaagctcaagcaatccacctgccttggcctcccagagtgctgggattataggcacgagccactgtgcctggccggaagctccttaatttggccccggtgtctcattgacatacctccatcattgtgctttttgttttgttttgtttttagcacttccttacctttgggcactacaacatgctccagactcatcatttgtatttcttgcctaattttagaattaaccattccttcaaggagccctggttccttctataactattttttttaattgcgatataactcacatactatataatccacctatttaaaatgtgcaactcagtagcttttgatatattcacagatgtgcagccattgccgcaatcaattttagaacattttcatcaccccaaaagaaatcttataccccataagcagtctactgtccatttctcatgttccccggtcctagataacactcttttgatttacctattcgggatatttcatgtaaatgaagtcatataatatgtgatcttttgtgcctggcagcttttacttagcatgatgttttcaaggttcgtccatgttgtagcttgtattagtatttcattcctttttatggccaaataataacttcattgtctggatataatacatgttatataatcattagttgaaggacattggtttatttgcgtgtttataccttttggctattatgaataatgctgcaatgtatattctatacaatagcctttctaaagattttgttgttgtttgaattggaattagtatctacacaattgattggtatacgttttaagtttcttttaagtgataattatcccctcttcacctccctgttttcttctttgtcatttgtccagaagaatttccacatggttgggatattgctggttgcttccccatggtgtttcttaccatcttcctctgtcttttttatttttatttttgtttcttaattgttagttggatctagagatttgatcatttcagggttttgttggactgccacataggtgatggtaatttattctttcatcaagaggtgtgtaatgtctgtttgggtctgtttctctgttgctattagctaccagggtttagaaaaccatagctaggctgggcacggtggctcacacctataagcccagcactttgggaggctgaggcgggcggatcacgaggtcaagagattgagaccatcctggccaacatggtgaaaccccgtctctactgaaaatacagaaattagccgggcatggtggtgtgcacctgaagtttcagctactcaggaggctaaggcaggagaattgcttgaacccaggaggcagaggttgtagtgagctgagattgtgccactgcactccagcctggcgacagagtgagactctgtcttaaaaaaaaaaaaaaaacttaacagctaatggtcagttgtctctggcttgttttttaaataacctataagctaatgttgatttttacattttgaaagtgtttttaaaaaagaattaaaaaaataagcaaaggagaatttgcgacagcaactgtgtgtagcctgaaaagcctaacatattttctgtctggccctctacagaaaatatttgctgacttctgtaccgtttactttttattgcctagagctgttgattcattaggagttgcaaaatagtgataatctatcattttttcatttatttggtagagtacttctataaacagaaactttcaccaacaattttattgccaccaggaacagtttgatggggaaagatgtttaatttttttcctcttccttttgaaaagttttcaagatgatttggttctatagcattcacgaaagatgaccaattagtctttatttgtttttttttttttgagattaaagtaatggaattcaacagatttgaccatttcagttgttttattatcattattgaagcctaaatgtcccatgggtcttcagaaagttcatggaaaatgcatatatgaaaaaactatgcatggatttcaaaatttctttacatcaaaataaacttgtgttaacttgttataagatgcctgaataggatctagtttgaggtgctaccagggataaaacatcattttgagaaaagcccctatcagagcagtatgaattctgctaaaattgaagcaagaacaaacgtcaaatttatggtgaagcttgggtggaagagtgctaaaatattgatgcttacgaaaagtttatggggacagtgcccccaaagaattcagcaggttacaaatagataactcattttaagaagggacaaaacagcgttgaagatgaaacccacagcagcagatcatctacatccatttgcaaggaaaaaattcatcttgttcatgtcctaattaacagcacaaacaatagcaaacacaatagatatctcggttggttcggcttacacaattatgactgaagaagttgagcaaacttttcactcgatagatatcaaaaccattgtgcccagatcagctgcagacaaaagcagaactttgcatggaaattttagacaagtgggctcaagatcctgaagcattcgaagaattgcaacaggagatgaaacgtggctttaccagtacaatgttgaagacaaagcacaatcaaagcattggctaccaagaggtggaagtggtgcagtcaaagcaaatgcagaccagtcaagagcaaagatcatggcaacggttttttgggatggccaaggcatattgcttattgactttttggagggccaaagaatggtaacatctgtttatatgagaatgttttgagaaagccaaaattttagcagaaaattgcacaggaaagcttcagcacagagtccttctcccccagggcaatactcctggtcattcttttcatcaagcaagggtgactttgtgagagttttgatgggaaatcattaggcatccaccttaaagtcctgatttggcttcttctgacttctttttgtttcctaatcttaaaaaatcttcaaagagcactcatttttctttacttaataatgtaaggctgggtgcagtggttacacctgtaattccagcactttgggaggctgaggttggatgattgcttgagcacaggagttcatgactaacctgggcaacatggtgagaccctgtctcttaaaaaaaaagaaaaattagctgggtgtggtagcatgtgcctgtggtcccagctactcaggagattgaggcggaaggatcaattgagcccaggaggtcaaggctgcagtgagttgtgatcatgccacttgcactctagcctgggctacagagcgagaccctgtctcaaaaaaacaattaataataatgtaaaaaagactgcactgagatggctaaattcttaggactgagttctttagggatggactaactggttggtatcattgcttacaaaaatgttttgaccttgttggggagcttgtgttgagaaataaagacgatattttaaatttttatcttttaatttcatttttccacgaacgttttgaagtcctctcatatttggccagtcagagcctcttttttttttttttttttttgagaccgagtcttactcccatcacccaggctggagtgcagtggtgcagtcttggctcactgcaacctctgcctcccaggttcaagcgattctgctggctcagcctcccaggtagctgggattacaggtgtgcgccaccatgcctggctaatttttgtatttttagtagagacagggttttgccatgttggccaggctggtccggaactcctgacttcaggtgatctgtccacctcagcctcccaaagtgctgggattacaggcgcgagccactatgcccagcccagagcctcttttgagtgtttgagatgaccttagtggccattgatagttttattttctattatgatgagatgtttcatattcatctcattttctaatcccagacctggaactagccttttttttttttttttttttttgtaagttcttttcagtggaaaatgatgcgtagagaccaaaacctgagtatggaaagtgctcattgccactgggttggtcatcattactaggccttttaagtgaagtgagctaggaaatacctattttttaaagtagtaaaatgaatttatattagtacttaaaattgaaggctaaaagattatactttaatgttactgatttttacatctatagtgtttttcttctacaccaagaatatcatgttctccaaatcagtaaagttactcatttgctttatcccacaacacacacacacacacacaccctcagaataacaatactaatgctaactgcaataaaatggtcattaaaacagcttaaatttttttgcagttcttttggtccttagagtatatcctactatgtatagtttggttactgggttcttaaattctctcgaactagttctctgtgtgattttaatgacagctggtcaattaggtttgtctaatttatactttcaatttttagagattttttaaaatctaattttgttttttaattatgtaaaatgtttacatagcctcaaagtcaaatctatgaacaagttctgtgaagagacttagcctcaatccctgtctctttcaccatatttcctctccctgtgtgtattaaaagttatatatatgtgtgtgtgttaatatcctacatttcttaggtaaatacactcatttttctccaaacttacttgttttcacttaatttgttatagaaatcactccatggtagaaaataaacttattttacagtcttgcgtacaactgcatagtacctccttgtgtcagtgtgtcatagtttattcaacatgtctcttattgagggacatcaaagttgtttccaggttgttactacaagtagtggtacagtgaatagccttgcttgtacctgcctgtttttatattttggccagtgtatcttagggagagattcatagacatgggattgctaggtaaaagggtaaatgcatatataattgcgctagattttgcagattttcctctatagtgaatgcactattttgcatttccatcagcctattttcctatatttgcctacagagtatgtcatcaaacatttggatttttgccaatatgataggtgagcaattgtatctcactgtagttttaatttgcatttcttttattatgaagttgagcatctttttaaatgattaagggccatttgcattccagttcagtaattaattctacatctgtatgaaaatgatatgcagcagtgtggatagtcttattttactcctggagatgcatttacaactgcttttggtttatatatatatgacttcattgtgggtattttgaggttggtgtcctattcttctgatgctgttaacttctttcttagattttagaggtttcccctcttttcttcaatattattttgtatcacaagtgtgttatcaaacttttaagagctcaacgaatgaatgaaatttgtctatgacaggacgacagcttaccaatgcaggactgagttaagaagcttttgaatttagtttatctttatcagtaaatgcacagttgaatagaagaattctagaacctggtttacagaccttgtgagactatgacaggatttttctaacacatctgtttattttgcattgaaagcttgtgtatgcatagaattctttgcagaaactagctttgataatataagattcattattaaggatttttaatcttgtgttcttttcctttgcttatgtttaaattgttagattgtcctatgggatttcataaatattacttctgttagtaaagctgctgacagcagaagctttcaataaattattcatgtgctatttgttttctgtgttcatgaattaattcaacttagaatttttttaactgaacttggtaacaatttgtagacatatgggtacttgaataaaatctgtaatacttgttttccatatgaggaaagtactcttagcaatatttagagcaacatcagctctctagaacatagctgattactaaggagtaatggcaaaatcgctttaaaaatgtgaaataattactcttataaaactgctgctttttcaagatgtgagccacggaattatatcattttctacttttcttgttcactatcatttgtatacttactgttcactttcatttattgaaaacttcagatgttattttacgtcttcctctccattccaaatctaccattgttctcgataatttttatctacttgacttgcattctcaatagcattttcagttctttaacctcgtcatctccagtcacttctcttccatgccatttcaaacaccagcgtctataaatgtgccctatcgctttgtcatcactcaggagcgctaaaatattaaaataataccccagtctcacatagtctccagtcgttccaggttcctcacattatagccgtgctatttttatccatctcagttcagtcctatttatttccttccctgccttagattccatgtacaaccattttgatatcttttttttttttttgagatggaatctcactctgttgcccaggctggagtgcaatggtataatctctactcactgcaccctgtgcctcccaggttcaagcgattctcctgcctcagcctctcaagtagctgggattacaggtgtgtgccaccatgcccagctgatttttgtattttttgtagagatggggtttcggcatgttggccaggctggtcttgaactcctgacctcagatgatccacccacctcagcctcctaaagtgctgggattgcaagtgtgagccactgcacccagccactttgatgtcttgaaccctcttcattgtcactttcaactcatctgcctagaaaagtttaatttcaaatgtctactttccttccttttctactttataaaatcacattctcctatttgaacttctttaaatacagttaccaacgtcagctgggctctcagtgtagcccagtaattctgttttgcctctttagtgctctcttccattcttgccacagctatttcagatgttttccactacctgcaaattctggtccttcccaacaccaccacccttctctcatcatcagcagatgaactcatctcatattttagaggctattcaagccgttaatgattcctgtaactaactaccaccagacctactcatatgttcattcttctttcttgttacaagaggggcagcattccttcaatccaaaattaatccttctacacatcttttctcatgtaagcattttaatgctttaactttccctttaagcgttactttagttgcattgtccacattagacatgctgtattttcattttcattaaattcaaaatattttgtaatttctcatgtgatttcttctttgatctgtgggttagtttataagtgtgttgcttaatttctaaatatcttaggattttccaggtttctgttattgatttgtagtttaattccattgtggttagaaaacaaactttgtacaatttcaatccccttatgtgcacattaatagtcaaggggattcttctgccaaattctggagtatgcacgctctcacgcgcacgcgtgcgcacacacgctctctttcccactctctctctgcagctcttttctgtttgtactctgatctgcaaattgcagccaccttggcctccccaatcctaatctctgcctcttcaactccgtgagactgcaaagctctctttggtttcccccaccatgtgctgaggcctggaaatggtctacaggctgtaaaatggtatcattttagggcttactttgtttacctctctctcaagggtcatagtcctgtgctgtctattgtccagtgtctgaaaagcattgtctcatcgattttgtccagtttttagttgtccaaggcaaggagggtgagtcccatccttgatactctattgtggccagaagcctgcatcatcttaccgtgtaattgcctgtatctatttcagtctttctactggttctttccatcagcttttcaacatgctcaagtctctcctctattgcaaagaatatagaagaaaaccaagctcatgtcgtctttatttaccaacctatctctcctctaccttttacagccaaactttttgaaagttatctctatccttgctactcaaaaatattgtttgtggactgatagcatctttgtcatctaataactcattagaaatgtaacatctcaggccccatcctagaactactgaatcagaatctgaattttagtccaggtgcggtgattcatgcctgtaatctcagcactttagaggccgaggcgggcggatcatgaggtcgggagttcaagaccagcctggccaatatggtgaaaccccatctctactaaaaatacaaaaattagctgggcgtggtggcacatgcctgtagtcacagctattcgggaggctgaggcagaagaatcgcttgaacccgggaggcagaggttgcagtgagccgagatcacgccactgcactcctgcctgggctatagagcaagattccgtctcaaaaaaaaaaatttaataaggtttaacaaggtaattagaatatacactataatttgagaacactgtctacattttccttcttcactttccatcttgttccttagtgtgttgtagtctgtcatctgtttataggactacattagagctgttcttgcctggatcatcagtgactttctcaatgtatatctaatgaatgggggtctctctatctaatgaatggctgtgttttactctcagcagttcatcttcctttctgatatattcctttggcttttgggatgccctgttctcttgtcctctgacctctgtggccttttcaggcttttctttctctgcctgtctcttaaatgttggtgttctacagaatttggtccccagctttcttcagattttacatttctctgcctgtctcatcttttcctgtaactccagtttcaacatgtattcttcattctgaatctctcctgagttccaggattatatgtcctccacataagcaccttaaactctccatgttactgtggacacatgatctccttcatcatgtcctcctcctcagtgactggcaccatttagccatcgtccaagctagaaacttgtcattcatcttcaactactccatcaccctttcccctcctttactcaccttactttcgcatttattcagtcttaagacgtattgattccactctaaaaattcatcatgtctgccatttttttttctgtcactattgctgctttcctaaacaggacttcagtaggtttcaactgagattaccacagtggcttcccaactggtttccctatctccaatcttgttccctttaaactaatctccatttggcagtaagaatgatccttttaatattaagtaaatgtgatctttacttaccatcttaaagcccttcaagacccttaccaactcttcttaacttccaaacttattagcttaatgtatgaaatcgtcactatctggtcactgccttcccagttgtgaatttctttgagtactttgccacttccactgccagcttgtttccaggcctttgtacctactgttcctttgacagagtgtcttctgctcttcactggctggctcctgaggtttcatgtcattttgcaggaatgtcctccttgactgtctaggccggttagattctcttcatgtacgtatgtactttgtacatatcctgtcatggctcctatcacactgttctgtggttgtgtttgtggctgtgatcatatcattgtatatgtcctccactataagcactcttaagggcagatagtaagtgtcttgttcccttaacctaggtgcttagcatgtggcacccactctacaccaggcagggttcctgctctcattgagctaatagtgtattgtggggatggaggtgggttagggtgcaagaaacaaaagcaacaaaagaaaaataattttattcttatacatgatagatccttagtaatatttttgaaagaatgtgtaaattattattattgttttgagatggggtctcactctgtagtccaggctggaacgcagtggcatgatcatggctcactatgtcctttatctcctgggctcaagcagtcctctcaccacagcctcccaagtagctgggactacaggcacatgccactgtgccaggttaatttttttaaatgtattttttgtagagatggaggtctcactgttttgctcaggctggtctcaaactcctaggctcaagcgatcatcttgccttggcttcccaaagtgctgggattacaggtgtgagccactgcgactggccaaattattattttaaagagcccttcaagtgcagaaatcttgaatgttactgacattactgacttaagttcttgaaagttcagctttctaaactgaaagctaagttcagctatctaaaaatgtaatatacctttctggacctagtgttctgtggtaattaggttattgttcaaacccttcaaatctaattcttagtttttttgttttcttatgtagtttccctgaacagaactgtggtaatcaaggactagtggaggtgtactttagaaatagcagtgagaattaatggttagctttgaaaatagaaaagtaaaataataggtgttctatggtataattgttttttattaagaaaggatatgttttattcattgtattttataaagttcaagccattgatgctaaaattagaaaaagtttgtcatcaaatagctaaaatattgatttgatagccaacagatgaagttacttgaaataagctatattagtctattctcacactgctataaggaactacctgagactgggtaatttatgaagaaaagaggtgtaattgattcacagtcctgcaggctgtgcaggaagcatggctggggaggcctcacaaaacttacagtaatggtggtggaaggtgaaggtggagcagggcacatcttcacatggagaagtaggagagagagtggaggggaaggtgccacacacttttaaacaaccaggtctcatgtatcaccagaacagcaaggggaaatgcgccccatgatccaatcacctgccaccaggcctcacctccaacactggagattataattcaacatgagatttgggcagggacacagacccaaactgtatcataggcagaatatttagagcacctcttgaaaaatgtggtcactttattaattttgaactctatatgaaaatattttattaaatttcttgaaaaatcttatctactcagtatcagtgaagtgttttcattataagcatcagaaacattaactaacttaagtacaaagggcatttgttaggatgatatggggttgcttaaaggataaacagaaaagataaagaaccaaacaaatgtccactgtttcagttgggccagaggaattacttttctgcgaatgattacttttctgggcagggcattggatttcttgagtctatacgcctaagagtgcctgctgcgtgttgtgtagtttctggtttattgtaattgcttagacaacaacccaatgcagtgttttctcttgatgtcttaatattgtaaaagtatctaggaataaggacattttcctaaataacagtatcattaatcacatctaagaaaattaaaattaactcagtaatgctgtctaatatactcagcatttaaagtcatctggatattctccaaatgttttttgttgcccaggatccagtaaggtttcactcattgcatttgcttgtttctcattagtctcattagttcatgtaggacagtcttcttattgcctttgttttttatgacattcactttattttacttgaagagtccagggtagttgtcttgtagaatgtctcacattttggatttgtgtaattattttttcatgcttagatttaggttagacactttgggcaagaatactacatgctgcttattgcatctcatcaggatgtttatgaagccaggttgtcccactactgttaataatgaatttgatcatttagttaagatggtatctgccaaatctgtccattgtgaaggtacatttccccctttgtaattaatgatttgtggatgacactcaaattgtgtgacttcttttttccagtggttttagcattcatcagtaatgaatcagttattactgaacttttaatgaaaagtttctaaaaagtttcctttctaaatagacatttctgattaggcactaaagagaaggtactggtagtcacttaaaaatccttccatttttactgtttagatgtcagaccagttgtattagacagctgggaaagagctttgctttgattcctcacaattattgtcatgattcgtattaatcttttaccttttccagaaataatacaatttttttattagagaacttgattattttaaaacacattaatgaagggtaacataggccagtgcagtgctgtacaatggaaatatagtacaagccaaatacataatttgaaatcttctagatagcacattagaaaagtaaaaaacaggttgaactaattttaataatatattttatttacatgaatatatccaaaatattttaacacgtaattagtataaaaattgttgatgaatattctacattctgtgtgtgtgcaataagtcttctaaatctggtgtgtattttatattacttaaaatcttaatttagatgagctacattaagttaccaataactacatgtcacacatcactgtccctattggatagtgcagatatggtggttacaatcttgggcacaaaggaaccagactaacttgattcagatcttgccttcttcaccagctggcatcatgactttgggcaaattcttcattctctttgtggtgtagttttcccattgtaaaatggggataataatagttcttactactagggatggggaattgaaataattaatgtaggaaaagcactgaatccatctctggcacatagtaaatgcttagtaaatgttaactcttatcattatgcctttagacttcgtccaataattcccattctgtcttagaagtgtccttgtattttgtaagggaagttaggactagatattggatcccttgacttctgttttatatcttgctggttttaccctcagtcccttgctttacaaactcttttgtagtgactttctaaaccaataagatgaaatagattttttaggagacttttaatttcaagcattctcgccccttgttaccataatttattgaaatgaatgggaaaacccagcacctctgcaaatggcagtgagtaaatgagagatttatcattatgattttttaaacccacaaaagattgagagctacaatatattgggttgctttttctttgtaatacaaatacatctctcccacagaagcctatgtaattgtagcagtaaggtaaaacagattcacatacaaaattaaggtgatctcgaagattgatgaagtgtagttgtatctagttcagagttatttaggatggcttccagatttgttgattacccagtcttatattaggtcataataactgcagaagatagagaagggagtattaaatgaagttttgcaaaggagatgtcctgtttaaaaataacttgatggtttactgtgatataacatttggtacctagaatactagtatcattgcccatcatagaaaaataaaacatcattaaacaaagaagtatcagttagttgaagcctttgtaagcattcactgaatcagcattcctaaagacggtgatgttgctaaaatgaaatggtggtagttgaatattacagtgtaaaacaatgccatcattcaggggattgaattgtacctccaagttaatttttacattatattatcattgcagccatattttcatcagtatagcaaaagtggaactgaaaaatactcatttcagaaatttaaaagactttgcaactgtattgggtgaatgtgcatcagtattgggtcttactcttaggagaatcttctggccaccagtattaaaaagtggcttataagatatttctaggctgagtgcagtggctcatgcctgcattcccagcactttgggaggctaaggcgggaggatgacttgaaaccaggagtttgagaccagcctgggcaacatagtgaggcccggtctgtaccaaaaagacaaacaacaacaacaaaacccaaaagctttcatgaacgttctgtaattaatgtgaaacaattcttatatatttctcatctagcagaatgaaaaatgaccaattcagatttcccccacttttgagctaaagtatagctaaatatgagctaaatattgctaagactgtttattattaatggacttttcctgagaattgttttggagaatttccaagtaactggttagaacattaatggtactgtttgcaggttatcacattgccccttgtcttcttgcacatcatgaagaaattatataaaatattaactttagttatttatggtactttaagaagttacataaaacatttttacaaaggacagacttcaagtcatcttgagatcaaattttggagactaaggctgatcttagaaaaagcaatggagatttgatgttatccacagtcattaagtaccactaatacttaattccatcttggcccaggcacctttcctacctataggacactgaaaaaggataaaacaaaacaacaaacaaaaaccaaggtgcaaatagccatggcaagacgggtcattttaatactctctaatagtctagcctgctcatgggaagatagaccttagaaaagaggaaaaagcaaacaggtaattgctgtgaagattacacatagcgtagaaggatagaggactaggatctcttcagaaatagttgttagaaaaggcctctgtagaagggacagtttggttaaaacatgaaggaagaagctagccatgcgacagagagtgggtgcagggcaagtgttccaggcagaggggatggcacatgcggaggccccagcgtgagaaaggacatggcttgttcaagagactgaataatgtggcttattcacagcccattgagagaagtgagaggaagtgtgataggagattaggttggagagaggcaggaaccagatcctgtaggcaggccatggtaatgaatttgggttttattttagctgtactggggagttctttaaagattagggaagaaagatgatcaaacttggttttaagatcacttaatattattttacacataacagttgtcaaaatatgcgtagaagtacagtccatattattttatacataacaatttctaaaatgtgattgtgaaaactaaggtcctagactgttagcgattttgggggagatattataggtttttgaactgtgaatagttaactatttattgaggacgtgttatctgccaagcagtgaggaattttatacaaattctctctcatcttcacagaaatttccttgaaaggaggcataatttttcctgtttgatgggggagaaaatgttagatacagagagaaattaagcaactagcacacaagggctaggattcaaaaatatgtctgccttactttactgtcccatagctttttttagtgtctttttgcagggaggaagatggaggggagaagaacaaggctgaaaattgaagaaaaggaaagcactcttataaatttttgtggaataaaggaatttagatttttttttttatttgggggagtggttgggaaggtagtggctgtaaattagaacagtgtatcaaggtacattaccctatagaaattgaatcaccctagaatttccctataggacattatgatcctgaacaagaattttagatctagctttgattagacattgacatccagtgtttttatggtatagttgtatgccgtgaagttttaaaagcatatatgtttatcagacaattaaaatgatctgtataatattaacaattaattgcatgttttccccaggagaggggttctgtaaagttgaaatatagggaagatgatgtgtctgaggtagatcagtctttggagaaatcagctgtgcagggcagagagagactgaactctggaaccaggagcactaactgttacgtagcaaagcagggtggaaaatgtttgttaacgcttaagtgttgcctgctcttagttaataacatgaatgttgttgagatctttgaatgttaaattattttaattttctaattttctaaggtagttgagaatttgaagcaagatagtctgaaccgcatagtgatagtggacactaaagaatcaagatggatgaaatgtaggatttggagactgacgagaagggatgggatggttgaaagaaacattaacaagtagtaaaaaaagaaaaataggaagtcctttgacagtagtgtcttagcttatgataataaagtgatacttttcttacaatgaacattatacagaatgcttgcatttgtaggtatataaaaatgctacttatccttctgccctgagtttctgctactactaaactttgaacctcttttggcaataagacaggtttcattttacttctgcaagtattcagataccatatgttaatgttttactctgggtacaataaagtttagaattattactggtcacacacaattaagacatgcaccgagggatatgatttgttgatgttgttgggagttacaacagaaaggagttccctgtggatattttctttctgtaagatggaattctatcaagaagtgtgaagtattctatcagaatgtgaggaatagtctatcaagaagtgagagctattccattaagacgtgagaaatttgaagagacttgggaatgtagaagatattagataggatcattaaacctatttcaaaatggaatccagtgactctggccatactaaaccaaaattaagcaaatataattggctgggagtcaggtccctggggagaagtataagccagtttttatacaaagtcagctaaggagtgagtgtttgataacccttttattgtaacaaaaagtgggtaaagaaaatgatgatagatcttttagaaaataatctcctgttccaagcaaaggattgttctccaccaccaccaacaaaatttttgttactgaaaaaaaagataagaagaatgtgtatgcaattgttcatatatatacatatataaaagtagcaaacagaaatacacggagtaaaaagtgttctccctgtacgctctctgctctcttttggcagctcaaacccactactctccccagggagaaaacaatgttaactgttcagtgtttgttattctagtcttttccctttgtatttgcatttaaatatgggcacacaagcatctgtacatgtgtacatattttaatatcagaagagtcatactcgacatattttgaacgtacattttttattatttatgtatcttgacaatcttttaatctcagcatacaaatgtaccccagacttttcataatgttcctctcctgtgcagacgatatgtgtgtatgaatttatgaatgaagatggctatatttctgcttaagtaatactatttttatgtaaaatatttagacaataccaaaggtgaaagaaaaaattaaaaatcaactgaaatccttgagataatccttattttggcgaccatttaaaaaatgtttttctttagctatttacacgagtgtgaacatacatcacacctgccacatataaaggtataatatttatttatttatttatttagagacaaggttttctttggtcatccagactaggtctccctcagtcacccagactggagtgtagtggtgtaatcttggctcactgcatcctcttcctcccgtgctccagtgatcctcccacctcagcctcccaagtagctgggactactggtacaggtcaccactcctggctaatttttgtcttgttttgttttgttttttggtagagatggggtttagacatgttgtccagactggtcttgaactcctgggctcaagcaatccgcctgccttggctccccaaagtgctgggattacaagggtgagccacagcacccagccaatgtagtatttataagtggattatacatacaagatgatttttgtcatggaactattttatctgcttggggatttttatctttcctctactccctttctcctatctttcctctcccagtaaccagtagtaacaacctggtgtacatttttcctacctttctcaatgcccatataatcatatacatatgaaattatataatttacactcatcttcattattcatttttcacagaactgattctacatcaactgaaatgtagcccactcattttttttttgctggataatattctaaggcaaggatcagcaaactgcaataaacggatcaaatccatccagccacctatttgtataaataaagttttgttggaacatagcttcacccatttttgtattgagcagtttaaccttttaaattctttacctgttatatgtgacacaattttccccccaatccattgtcttttgctttgttatggtattttgccataaaaaatttttttttaatgcaataaagtaaaacatgcctcttcttttctagcttttagtttcctattttgatttaaaaggctgcctaactccaggattatccttgtattttcctaaaatttcttctaaggtttttatcacttgcattttttataggcctggaatacatttttatgtctatattgagtggcattgtagtataacgtagtataagatcacagataatgaacaaatagctaacaataatgtagtataagatcacagaccctggttctgtgatttactacctgttcgacctttgacaaggtccttaacatttatatgttgttttcctctctaaaatggggctgattcttgtacctgttttgtaagatgatagtgaagcttaaatgagtggttattatgtagaaaatatttcgaacattatctggtacatagaaacatgtgcttttactgttattacatggtgtgagtaggcatctcatttttttcccatatggataaccagttgtcctagtaacatttattgagtagttagttcatccttttcctcaatcgatttaaaatgtcatctctactacatgttaagtttccaaatatatatagctctgtttgggggctttatagcctgttatgtgtctttatcctctgctccagagccacagtggcttagttactatagctttatacatacttgtaactaacaagtggagtccctttactttgttttgcagaattactttggctcttactggctttttttttttgctcttccatatagttttgtaaacactcatcagaatttacaaaaactgtttgttattaagtcttagtgtggaaaggagtgatactaagtggccattattagaatggaacctgcagtctcttattaatactttaaccattggaagtttttagaagttatctggttatgtaatctaaagattagtgccatccaccatgctaggtgggtactgggaatatagcaaatgaaaactgtacaaagatagatcataagcctgcatttcccaaactataccctgagatacccaaaggaacctcagagaactcccagggtcatttcaaacttctagggaaacatggccacatctgttggacattatgcgaacttctagctcaaggtagttcacagtttcaacagctgattgtgccatcttcattttgtacctgtgatatctttgtgaagttgagcttttagtggttactgttttaaaaagcaagtactatgcaaaaatcagtgtggaacaggaaatgtgggtggcagtatttagttgcacagcatctaagttttagaagttgtgcagggccctgtaggtgaaaacatcccatagtaactaattgtggttattttaaaatgaaatatatatatatatttttcagtttgcatgtattattttttcaaaaaggtgttaatttgttgggacatagatactcattttgtttgaacctaactgttaaaagaaataggatggttagctatctcttttgacctatggaattcttgaaagaaattatagagaaaataagggtaccaggagccaagcaagtttgggaacctctctactttaacttaaagttattacaaatattcaaagattaagaacatttggagtgctctgtaggtagcgcatacaccatgcttgcttagaacaggcaaaactaacattgcctgggcacctgggacagacagcatttctgagcaaatgatatttaagctgagcttgaaggaagactgagaactgactgaaaaggagtggtggtgggaatagcttgtgtgaagaggcgggagcggtggggaactgactgggagagcaatgcaggggagctggaaataggcagaagctagatcaggtggtgactgacgtggcagtcgactaaaggagtttcttcaggtttctttgtaaaaggcaacggcaagcctttgaggggttttaagtgaagagaggatatcttaggtcactgccctcctactgagagaacaaaatacaaaacgatatacagaaatatttaagtaactttttgtaaaaattttgaagtgccttgattttgaaaggcatttgtaagctttcctttgagtgtaattcactcttactttttcaaacacatatactttttttcgttgttcaacctggctcaattttaaaaatgaaataaaaagcaagacagtgttaaactgcgaaacatttaaattgtaattttgggggtattttttcaaatggcaaaaattgtgttgtaattttgaaatagaatgtattttattatcagtaatacaatatttcagatttttaatttgtgtattttaaccaccaatctaacacatttatcttttaagtttctgagttaagtttggggggtataatagagatttaatagttacatagtaaagatataaaggtaatttctcttagtttagctatctttttatactttttatttatgtgtttattctactatgattccagtaaactaatgcaacataaacattttgatagtaataagaaactaattgcaggttactttttaaaaatttctaagcttattttcaggaattttaagacttgaaaaataaatttcatggtcattaaatgggcatagagacctgaaacactttttttttttgagacggagtctggctcttgccaggctatagtgcaatggtgtaatctcggctcactgcaacctccacctcccaggttcaagtgattttcccgcctcagcctcccaactagctgggactacaggcatgtgccaccatgcctggctaatttttgtatttttagtagagatggggtttcaccatgttggccaggctggtctcgaactgctgacctcatgatccacccaccttggcctcccaaagtgctgggattacaggcgtgagccaccgtgcccagccacctcttttctaatacctgcttgtggtgtttgggaaagtgtaattagtctgattagaattagaatttgtttatcattgaagtattggaaaacttttaaaacaattgaatgttatttcttttcctctgccagtgtgttttatatttctttagaggtgtttgttcattatataatatagaatttatgtcatccttaaattcataatgcaaataaattataaagaagtgtgtagatatattcgaaaaacagtcttagtttcatttgctggattgggtttctctgatttttcacatgaagaaagctgatgacaacttgagttgtttacaagggaattggtcagaagttttcttgaagaaaagtgataaagctttaagttggaaagctttccaacaggctgagagtataaggtttataacaaatatttttctttaaattttgttcttcccatgttcaaagaactgacagggacttagagaaagtaagctaattccttccgtgctctttacactaaaatgaattctagatgaagattaaatgtagaaaatcacaagagtaatagaacaaagcaaggctgaaattttttatgatcttgggataaaaaagacctaagtataactatgtttagttttatgtagcttaaaatttattcttataacaaatattataaagtcaaatggaaaaaagaatatttgtaaaatatgatagcagattgctttttaagtcagtcggatgaataaattctctagaaaatggacaaagtgtgtgtatagtaaatttatgaaaaaaatacaaataactgataaacataaaaagatacctcttaagaatcattttaattttctgcctcttttatgttcaacagagaatttcactttgaatgcagtaacttaaagtatttataaatctgattctagggtttgaaataaaacttttattagatactcatgtcatttaacaaggcttgtttatctcaggtagaaggtttttttttcccctaatgttcttctaaatggctcaaagtttggtttcctacttgaaagtaaatcttatttattagacatttgtagtgagatgactatatttatgtgtcacattcaaagaacaacagttaataatttttggacttgttagtaatatattttctgacaaataatagaagagagatttgcttaactttgttctttttctttatttttgtaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtaagttttaagtgatttttttttttgcattttcaaatatttataacatacatcttgataaaagcactgttctcttggagttttcttttaattagtagcaacaaatatactcatttaacagatatcaattgtgcatatactctgcgtatgggaccttgctgtagggcttgctcagtgccgtagagaataaactgtagcgtgtttccacttgtctgatggcttaatattgctatcagaagtactgagcagttcttttctccttttaaacttggaagtggcagaggaagtggtataggaaaattaaatcactttgacggccaacttctatcttacccagcataaccatttagtatggttttgtaaaacttgcagtaaagtcagaatcctggttccttgatgccttaaccaaggaaatgacattcaattggattaattgttttaaaatctacagagtgtatattaaggtggagagcagaaagttataaagagaggaactttccctccttttcagagtatccttatttgaagaatgatggaaagtgtaagaaaaattagggatcttgaagagtaagatgtggtttctaagtaagtcatgtctgttttgtagtagatactagcgttcctgagatagtgtttctttacttgagtaccagatgaaatagtttttgtgaagggtcatgttatacaaaaatgttatctttaagtcctgtatttactctcaccttggtgaaacgcccacgtgtgagacagaacctcagagacagtagtctcccatctcattcctactccaggattatggtttcccatctcatgctcactccagagtatatttgcttatacattcagagcataatggctggtttttttcctctttggggacaaatactcaaagttgaatttgggtgtgacaaagtttctgtaattattccataatcatagattgaggatggaaaaataaaagaagaaaaaaatgggtccttttgccaatttcccttttctttccttccttctctccctccttcccttctaccctcccttccttgcttccttctttcctctttttatttttcttccttttcttttctttcttctctctcccttaaaaaataatctatttgccaggctttctccaacatgtttcataaataaattagtataatgactgcctctacaacgtcacttaggtcagtgtctgtttataatttaagttcttaaatatctcttatctgggctttattcatgggctccttcctctcggctgtccccccatatactatcatcaaatccagtgaattctgcttagtaatttctctgtacttaatccactttctccttcccgaggctactcccagtcttccctcaccacagccttataagcatctgcctgctaccttattcttcccctcctccagtccagtctccaccctgtctagagtactctttctcacccttcagtgatcctccagtaacaccatcaaggtaacatctaactcttaaataacaggcctgttgattccttttatgagctgtcctccacttctccaaccttatttcttaacatttcaccctgcctctgtccccacccccgtcccctacatccaccatcaccctcaccacagttttaagcactggcagtactgttttgtttcctttcatttattctctgccttccagcctttgctcatggcatccccactgcctgttaattttatcctccaccttttcctcactttcttctcctctgctaagtttgtccattcttcctctttgataccttcaggaagcatttttttgacccagtatctaagcaagcagcaccgtagaaggtgatacattctgtgatgactgcatacagggttctgtaggaaagttatttaaaccactcttggccctaggtatcaggagtaaatagtgcccaagctaagggattaaataaaagttcttttaaatagttgcatggtatacattgtctagatatacatactgtgatttatttaaagatttctttattgatgaacaattaaatggattaaaattgttggatgttataggcaatactatagtgaactgccttctgcaaatctttatttctgtaaaacagattactggaattgggattgctggatcataggatacactgtgtgtgtgtgtgtgtgcgcgcaattaaaaggtactagtttgtcagttcctcaaaatgttaaccatagtgttaccatatgacctagcagttccacttgtaggtgtcctggggtagttatgggttatgcagagtgactgcaagtgagtacaagatttcttcccggaatgatgaaaaggttctgaaattagattatggtgatgattacacaactttgttcatatactaaaaaatattaaattatgtactttagatagtgaactttatggtatataaattacatctcaataaaacctaaaaaaattctgccaaattgccaatctaaaagacttagagttttttggttgcaagcagtagaaactgattgtagccaagtcaagcaagaagggaagtttttgaaagaacattaaataggtaactcatagaattaagtatgagaggtctttttctctgagctgtctcatttctccacaaccaaaatttctgtttttctgcctgggcagtatgctggctgtgagtattttgtgcccagaggtggggtaatagggtgttctaaatacagacattgttaatatcttcttgtcaactccgggtcttaactcccactctcctttttctcctgcagttctccagaggcagcaggacaaccggcttccttcttgggagcgcaggaagctgcagcgttccctgccttgttatgtcagttactagtcctccatctgctttccctactcagaaattttttgaaatctcttgtctgccaattctccatatgtttttgtgagcttacattttaaaaattattaattttcatgagacctcaggaggaagaattttttgactctttaaaaatacaactgagctgggcgcagtggcttacgcctataatcccagcactataggaggccaagacgggcggatcacctgaggtcaggagtttgagaccagcctgaccaacatggtgaaaccccatctctactaaaaatacaaaaattagccagtatggtggtgcccgcctgtaatcccagctacttgggaggctgaggcaggagaattgtttgaaccctggaggcagatgttgcagtgagccaagattgtgccactgcactccagcatgggtgacagagtgagactctgtctcataaaaaaaattaattaattaatttaatttaatttaatttaattaaaatagaaccatattttggttttattgattaagatttcctcctttccccaacttgatcaaattctgtgtttatctttgttaattcttatcttctgatattctggtttcttaaaagtagatttttggtcaaatctggggagctcaaggtaaaaaagcagattttttagataattttatctttatttttttccttcaaaaatccccttgaaataaaaaaaaaataagaaaaagaaaaagtttattgcagggctgtaaaacctgtgtgatttatgtttggactaattcaccatcataaaactagaaaacctgtaatcatttctcatgatttgtttgctcttccttaaagaaacatattgttttattctgagcatagcaatcactttttagatattataatagctagttaagtgtttatgcaatatactatatataaattatttattttaagtactttttttttttttaacaatcctgtgaggcctgttattctcattttacttgtgaagaaactgagtcttagggagtggttaaataacttgccaacttcagacacccatgaagtggtggtgttgggattcagattcagatatgtgacttgaaaactgatgctcttagctgctacatcctgtggcgtctatatttatgacgacatttttggttcacattttattttgagatcattttaaacgtagggagtaggtgcaagaatagaaccaagaaatctcatataccttcacctagattacctgattgttaacatcttatcgtatctgccttaaccccccaaaaatgcatacatccaaagacatattttttcggagccagtaagagtaaattgcagacaggttttcctgtaactgccacctaaatacctacgtgtatatttctttgaaacaaggacattctcctagataaccacagatgtccatcaaaattaggaaattaaccttaatacaatactactgtttaatttagatttcactgattatctcaataatgttctttatagtaaaaaccaaaagcagagtacccgcctgtcctcctcccacacatactcttatttctggcccaagattacatatttcacttggtggctgtgtcctttaaaactctttagatataacttggtttttccttgcctcattttgagtttgtttgatttctccctgaatagattcagattcctcatttttgggagaaataccacagaagtaatgctgtgttctcagtgcatcatgccaagaagcatgtgatattttgttctgttgctggtgatgttaacttttactacttaagatggtctgtgcagtgtttctccattgtaaagcttggtacttttgttagttaataatgagtattttgggaagagatactttgatactctgtaaatatactgttcctcatgacatttttgtttactagttttggtgtccattgaggattcatacgtgaatcagttattactatcaaatggtgatttttctagttccatcatttctataaggcaaagcttttccttttcttccacttatttgtttatatttgcatgaaccgacagattcttgtcttattcagtgggttataatgcatgttaataccattatcccagatttaatcagaggaagctcccttcagtctgacttctgtgcccttttgatatgtccacattgttctttggacagttttcttactttacgtcgtaagatgtaccaggttcatcttgtgctttctctccttctgcactcttagaattggccatttctccaagaaattatttagaaaaggtagagacaccatatgtaccattgctactgaagtaatatggatgctgcaccttctctgtggacagggctaggaaatatataggggtgtgtgtgtgtgtgtatatatatatatatatatatatatatatatacacattatatatattatatatatgtatagcaatgaataaagactagacaaaatgtgtacatgtttcacacatacttttatatttatatagatatcatatatatttttatatctatgattatataaaaccatgatgtttacactgatacctccattctagaccagtaccataggacttattctacccatctccttttcaatgtttataccttgcttctctaactgtgaggaatctgattccagttatccttaatgcatttacttatttgcccagtatccctgtatttagctaatttccatggactttcttctcaaccctggttctgccatatgttgtagccatgtgagctgacttgctcctggctcccaagacaaaattttaaagtaatatttaaataaattttatttcttctcttcctttattgtccaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccaggtattaactcattatcaggactgatggttttatgtttatgaatgggtaaacattgttctgttagaatttttaaaaataatgaatgttggccgggcgcagtggctcacacctgtaatcccagcactttgggaggttgaagcgggtggatcacctgagttccagcctggccaacatggcgaaaccccatctctactaaaaatacaaaaattagccagacatggtggcaggcgcttataactccagctactctggaggctgaggaaggagaattacttgaacccgggaggtggagggtgcagtgagctgagattgtgccattgcactccagcctgggcgatagagcaagactccatctcaaaaaaaaaaaaaagaggaatgttaatatgcggtatgacattttactgtcagcataggaagtctcagtttcttacagaagtgaaaagaagaaaatgtgccagaagatccactctttagggaatgcattattaaaaatttatcaagcaataaagtatattcactgtctaatggtattcttcttggtcaaaaaaatattagtgctgtgtcttttgtcaagccttctctccaacaataggatatttttattgttaggtcttttcacttgtgcaaatcagagacccatccaggctagttcgtataagggatgggttgggtggtaagtgttaacatggtggctctagagacaatggcaggcaagagtccttggatctttatactccccattttagtgtaaattcagctcctatttcagtctttcttctttttgtgtgtcttctcagttcctgccccttctggtgttcctcataatcaattttgtatatcttttctcactgtataacttctgcttactcataacttcctcccagttgtagctcatcatagcccctctagccttttggtgtttcatgactgtttaccttctgttctcactgctaggtgccccctccatatttctcatctcaaatttgagtttctgaatataattgaactatccctacattatttgggaagagttatatgtctattaaataggctcatttttaatctatggactggttcgcaaagcaggactgtgagctacaactcttgagggtgttcctaatagcccttcaactcataaatgtaggttctttttttgtcgttatccctcgtcattcctgtctcagtatattctcagcaaggacagtatcttttaaagtgtgcgtttgtgcgtgtgtgtgtgtgagcgcctgtgcacgcatatgcatatgtgtatgtgtcttgagacacggtcttgctctgtaacccgggctagagtgcagtggtgcgatcttggttcgctgcagccttgatctcctgggctcaagtgttcctcctacctcagcctacgagtagctgggacaaacggtacacaccaccacatctggctaatttttttgtattttttttagagatggattttgccatattgcccaagttggccttgaactcctgggctcaagtgattctcctaccttggcctcccaaagtgctgggcttataggtatgggccacagtggccagcgtgagatgtatattattagatcttgtcacacctttgctcaaaactccctaatggttttccatgtcattcagagttaaagttctgggctgtaaagatttataatcttaataccacttccttcctttctctcccctatcccatctcctactcttttctccctcactcgaagattgtgatcactttatgtttctagaacaatccagatatgctcttggccattttctctttctggaatcctctttcctcagatacctgcctgggtcactgtcttacctctctgctcaaatatcgctttatcagtgaagccttccttgaacactctgtttaaaacaacaatctttgatttccacccccagtgttttctccttctaccttcattttacttcagaacatattaccatctgacatgttctatcttacttgtctctctccctcattagtatgtaagctcaaccagagcagggaatttttgtctgctgccaaaaacactttctggcacatagaagccagtaatattggctatgaatttgtttaattgattctatcaaaattcaattaaatatacctaagtaattcaagttgaattaaaaaaaagaactattgccatataccaatattattcagtctgcttgctcacttgcttttacatgacagaggtaatacttctcaacacctagggtagcatttaagcaaatcctcaaaatctgaatccaagaaaacaagatttgtagtgtcaaaaggtgagatcactactcaacatctgaaacgaaaacataatgtggaatgttttgcttacttaagtaagggagagttgtgcttgtcaaacatagttttcttgagcaaagctaagtccttatctcctatagagtttttcagaagacattgttttgggttgtactggttaagagacagaggtggattaatgtcagtcatagaaatatgttttgtggttgattacggaggtgggagcaagttaatgtcagccttaaaagtcagtgactccaccattagttggctgacttttaaagcctgggcttatcactgattggctttcaaagccacattcacccttgtgagttgtcactaatcgattaggcaatgtttccttgttaccatggctacaagactgtcattaattggttagacaagtttaaagctagtcctggaggttgttatcatggctgtagaacatcttttccaaagcatatgggcacaagagtcacatctcttctgcctgagacctttttgtcaaaactcaatattaagttaatattaccttattgaggagagaactctgtcttctgcccacaagagtgtggccttttcatgtattcacaagaggacaactctataaagtgaacacacattaattctaatgtctgaataagaaatacaaaaatatagtggtagctagattgttgctcagttacaaaatcaagggactgacagactgagcaagttaaagagacgaaactcagaaagcttttcagaaataacacacagatacagggaaggaaaggaaacctcttatccctgtgagtaaggagaatgccatgggtcctgagcttgctcagtctccactgtttgtacacatggcttttatcttatctttcaatgtgaatgggattcatgtcaaatatctctcgattgattgacaagtacgtaccctgaaggcaggagcaataagttatacatccttaagacccctaaagagcctagcacaatgctttgcacatagaatttatttgagaagtgtttgctaatttgaatggaaatttttgtatcacttttgcttaaaatattttgtcatataaagccacacagactgaataagaaccagtcattcctcaagattaaagcagtaaagtgctttgtcgtgtgtgtatgtggtaatgatggggtcttgctatattgcctacgctggtctcaaactcctgggctcaagcagtcctccctcctcggcctcccaaagtatcgggattatgggtgtgagccaccatgtccagcctgttttgtcctttaattattgtctttgttaattttttttttttttagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaaggtaagtgttgtctgcctaaaagccttcttcagccttagcttgagactttgtcatatcccatttgggactattgactaatttaaaaagattatcaactttatttaaacacatcataatgctcatatgtcatccttcaaatatgttcatatgatatatatgatgaggatatttaaagaaaaagatactttcaaaatattaagagataattattccctttgttcctgttgaagccgcagtgtactcagcttaagtcttcaggattttcttccctaaattgttgcaagagctttggtcctgagtagcctgagtcttctcacacattctcatatgcatttttttgatagtagtttttccactgcacaatcagtatgagaaactgggctggccacagtggctcacacctgtaatcccagcacttcgggacgctgaggtgggcagatcacgaggtcaggagatcgagaccatcctggctaacacggtgaaaccccgtctctactaaaaatacaaaaaattagctgggcgttgtggcatgtgcctgtagtcccagctactcgggaggctgaggcagaagaatcgctttaacccaggaggcgaaggttgcagtgacctgagatcgcgtcactgcactctagcctgggcgagagacctagacgccgtctcaaaaaaaaaaaaaagaaactgtattcctcatcctgttgtttttgccttttgaatcctatcagaaatcacaaattcttcatctttcacaaaataccaaccactttactgtccttcctatctcctctcattacttccttatgcagtgggtgcttttcttaggtgtgttctcataagagatgtggggtggtggtaggtaggtatgtttttgcttccaaaataatgctgtcttgtgcactgtaggatgtttactggcatccctgccttctacccataggtggcagtagcacttccgcattgtgacaaccaaaaatgtccctggatactgtgagatggtccttgggaagcaaaattgcccccagttgaggaccattgttctacagcagtgctgttcaattgaaatataatgcaagccacacatgtaatttaaaaatgtcttacagccacgtttttaaaaagtaagaagtacatgtacaataataaatataatagtaatattttatgtgatgtaccagttaatgtgaaatgtagttctaccaaaagaataaagtttatgtttagtgggaaacattttaacacagctttagcttgtacatttattttaaaatttcagaaattcagttctgcagtcatacaggccacatttcaggtagccacatgtgactagtggctattgacttggacagggcagatctagagtttcccagttgcaaaatcaaaagtgaacagacaattttaatttttatagttcagtatccaagacgtagaaacaggtatctatctagttatctgggtgatcagccttcagtgatcactggggaagatggaatacaatcagattgttccccacgtgctccattagcaaaacatggcatcctccccaatatcacctgatttctttctcatcatccatccactcaccaacttcctgtcttcacattttgcttcctccctgtctttccactcctctttccagctaaatattacataagcaaagaatttataagacttcatttttttttttttttgccaactgaaacatagggaaccttaaaatagtgataaaaatgtgaagttcttacagtagaaattttaattggctacaagttagaacaaaatctttatcaggagtaggaaggctgaaatatattattttaaaacatattttgtcatgaagggacattctgaagatataaaacttatatataatgattttttatgtcagaaataaatgtgaggctttctatgattctcatttgttcaataattactcaacaaatatttaccaaatgctggctatgtcatgcatgttctaggtgctgggaatagagtagtgaaccaaatggagttcttgatcttacagagctcatagtctagtgggaaagagtcagataataagtaaaaatttaaaaatgtcagtttatggtaagtgctatgaagaaaagacaaattatatcaggagtgtcaagagaaatagaggtaagattgctattttatacaacgtgttagataattgttcttttagtagaatgattctcagactggggtctgagtgggccagggtatgcacatcatgatagaaaagtttcatatcttcctgaaacatccaattttattcaaagatatccttgggagcagatgatttttaactaaatcaaatgtgaatatattatggttaataacactgctctgaattttaaggataaagcagtagactttaagattgagttaacttatttctgcctgtagttctctaggctcctgaatactcagattaggtggctgaaaagtctgagaagcactgccttggtatgtcactgtctcaagaagcttcagaagaaaataagagcaggacagtgttggtggtgttcacattggtctttccagactctagcacagtgcttggcccataactggggaggggaagtggtggccaatatatttagcttgaataacccaaagtaatgttggaaaatataagtgaatggagcacaggagtgcttttggttggatgtatgtaattacccaaaatatctttgtttctgctagagccttatgagatatgtagataggcctcagctaataaattatttagacccaaaattagaaagaggcttagaagttgaaagaaaaaagtggctagaaattcagatagtgttaggctggatctagtaaaaaaaaaagatcttaaataactaaacatccttctttattactcatcttaagacttctttgaaagtgaacttaagaacatttccatggcttttataaatgtccaaaaattgatctatatatttaacctttgatcaaatttgttcagatttacaataatcatcgctaatgaaagaggggggtggaaatggatcccattcactaagtagttttattttaaagggagagaatctggaaaatataaatgctagtgttcaaggtgattgacagaaaaatgtaatttagtagtcaaataatgttatcttttaatggaatgatagatctgaaccccactgcaagggaacaggttaaaatgcttgatattattacaattgacagtagtagaaaaataagattatttaaaaagtaaatggaagacttccacttctgggaaaattgagtagatatatttttccctattccttttgctaaatacacctaaaaaccctggatgttacatgtgaaacaaacataagaagactctgaaaggtagagagagaaagactgagattgagtagctagggagcttgagacccaaggaacagcataattgttagttcttttttttctttcttgagacagagtctcgctctgttacccaggctggagtgtggtggcgtgatctcagttcactgcagcctccgcctcccaggatcaaatgagtagctgggattataggcatgtgtcaccactgccagctaatttttgtatttttcatagagacggggtttcaccatgttggccaggctggtctcaaactcctggcctcaagtgatccaccaatcttggcctcccaaaatgctgggattacagatgtgcgttactgtgcccagccaacttggtggttagttctgtgggctcagtttcccgccccccccgccgcataagaccctttcaggaacctgggctgtgttttgcctcatatatcccagacttggagctaaagaagctagcaacctggaaatcctactaggcacaaacaaaaaaagcctcaacagaaggtgctctctagccaaaggggcaggaaaagagcatctcagcaagacaaaagctgttagactgtactttctcctactccagtcaaacaccgcagaagaaactgtggccccaccctaccatgccagtcaaagaccatgccaggagcctagacttccacccttcccaggttgtagtgaagcatctcagcctccttgctaagtggtgtcaaagttggagtagggagccaagacttttatcctagccaggcagtaatgaggcccctcccatgtaagtagagaacaaatggagagcctccactttcaccccatccagccataagaggcaacccttcccttcacactggggtggtatcaaaggaggcccagcggagagtcaaagctttaccatcatgtagtagcaaggctcgcttcatggtgtcaacaccatgtgaccatgtgggggaacaataatgagacaatcctaccccttctacccagggaggcatcagtggaggcctagtggggagctggaactcccaaccctgctaagaagcaatgaggaaacccctccccacttacatgttaatggaggctgagtgggaaacctgaactacccccacctgacagtaatgagacagcacccccccacacacacccactttctctgctagagtggtgttagaagaagagagctaaaacagaaggattaaataagatccagagtgtcataacatagtacctaaaatatccaggtttcagttgaatgtaatgcatcatgccaagaaccaggaaaatctcaactgaaaggagaaaagacagtgacagagattttagaattacctgacaaagattgtaaagcagtcatcatagcatcacttcagtgagcaattataaacacatttgaagcaaatgaaaaagtagaaatctcaacgaagaaagaggtctcctcagtgcaggtttgaaaaaatttacctctctttcaaataacaacaaatacaaaactaaattaaacagttttcttttttgcttttctcttcattcttaccaccctaaagaagttgtctttaacatctgttttcttctccgtttctttatctgatgtatctgcaagattttaccttctacatgtctttggaatccatccatgaaggcaccatgtgccttattctaagttacagtcggtgcagtggcctcctaattgttcttcctacttgtactctggcctcattccaaatacaccttcacactcctgccagagcagtcttttcaaagctcttattttaccacagcactctcaaccccctacccacttttaaaaatgtttaatggatttccgttgttcttaggttaaggacccaaattcttaaaatggttttcaaagccttatgcagtctggctccatcctcatcctcctctattttcttacactttgccacactgatttcttttagatccccaaaccactgtgatcctttctgccacaattaatttgcatgtgctagtctatctttctgaaatatttttcgcacctcattatttagttagcttctactcattcttcagatctcagcttaagggttactttgtcaggaaaatctctcctcatccctaatttcctggcaggttcttttgctataccattttgtagagttatcttctatgtctgtgtttcccacttgagatgcatgacagcactgattgtgtttttgctcagtgctatatccccagctgctacctgacacatatagacaaaccaattaatatttgttaaatgaatgagtaaatctctctccttaccttctttatccaactttttaagagtagtcaatacttttttgctttctttttgtccctattgttacggccataatcttttgctctttaattctggaccattgtaattatataatcaaacttctgctttagtgttttcccatcctttttttgtttcttcacgaagtctgagtgtgtcattactctgctcaaaagcctttccctaagacctgaaaccataaaaattctagaagataacattcaaaaaactcttctagacattggcttaggcaaagacttcatgaccctgaatgcaaaagcaaacacaagaaaaacaaagataaatagatgggacttaatttaaaaagcttccacacagcaaaagaaataatcagtagagtaaacagacaacccagagctcgggagaaaagcttcacaatctatacatctgacaaaggactaatatccagaagctagaaggaactcaaacaaatcagtgagaaaaacaagcaatcccatcaaaaagtgggctaaggacatgaatagacaattctcaaaagaagatatacaaatggccaacaaacatgaaaaaatgctcaacatcattaattatgagggaaatgcaaatcaaaaccgcagtgcaaaaccaccttcctcctgcaagaatggccataatcaaaaaatcaaaagtaatagatgttgatgtggatatggtgaaaagggaacacttttacactgctggtgggaatgtaagctagtacaaccactatggaaaacagtgtggagattccataaagaactaaaagtagatctatcattcgatccagcaatcccgttcctgtatctataatgaggaatagaagtcattatacaaaaaagataacttgcacatgcatgtttatagcagcacaatttgcaattgcaaaaatatggaaccagcccaaatgcccatcagttgatgagtgaataaagaaattgtggtatgtatatatatatatacgtatatatatatacacatactactcagcaataaaaaggaatgaaataacaccattcacagcaacctggattgaatgggagaccattattctaagtgaaataactcaggaatggaaaaccaaacatcctatgttctcactcataagtgggagctaagctatgaagatgcaaaggcataagaatggtacagtggactttggggacttggaggaaagggtgggaggcgggtgagggataaaaagctacatgttgggtgcagtgtacactgtttgggtgatgggtgcaccaaaatctgagaaatcaccactaaataactttttcatgtaaccaaacgcaacctgttccctaaaagcctattgaaataatttttttgaaagcctttccgcttggtcaaaaaataaaagttctccttagcactccaagcttttccagactgaccctaggctactcagggataccttatgcccagcaatactgaatttacttgagtccattggctgtatatattttttcacattgttttttttctttgcctgcatctttgaattttggagttctaaaggctcgatggtctttttactgtgagccatgaactaattgaatgaattaattctgccaagcaaatggacattatttctcccagcctttttttaaagggagtaaaatcaatcccgttaagaaagactgactgctatgctactggtactcacatatgccaaatatcaggcacatcaagtatcaacaatattttttagtgtaattattagatataaattactgtatctcgctttcaaaaatgacaactagtgtttcaaattatgttcatctcagctgggtatcatatgtatacattgctgatttctcatttgatgaacattaagttttttgtttctgaaacttagtagtaaattttatccaggtataaaatgtaggattttaatttttgtaaatttttcttattttgtgaggcaccaaagacccgtcttatctctccatttattttatcccagtcattcctgctctattccattatataatatcttacttctgtgtttcatcaggtaaacctgggatttaagggtgttattaagacatttctgataggaaggttgcttgataaaggttagtcatgaccttgcagggtcgtatttcttggagaagtcaccaaatctgattctggctttcagctttctgtgtccagaaacttaatcaagtttatcagattcaggaagactgattacctagactttacaatgtaatgaaatttaagccagactagcactttatttatttagaatgagaattataaatgtggccaagactgtatagtcatttcctctgattttttttttaatcctataaggaattcttttttttttttgagatggagtcttgctctgttgcccaagctggagtgcaatggcgtgatcttggcttactgcaacctccgcttcccgggttcaagcgattctcctgcctcagcctccgtgtagctgggattacaggcatgcaccaccacgcctggctaatttttgtatttttagtagagatggggtttctcctgtaatcccagcactttgggaggccggggcgggtggatcacctggggtcaggagtttgaggccagcctataaggaattctatatgaaaagccaaattataatcagaacgttttttaattgatccatggacacagactagaaatgtaacagtattaagatttggaagaaaagtccagcctgtgaaaaccagtttagatgtggaacttcaaaataaaaatgtatgtatacatttattattgtgtttggtactgtattttgaatttatgtcatctctgaaagtgacttttaaagtggcagctttaattaggtacttgtccctagaattaactgcatctcttgccctatgtcaggtacctttatatgtctgattttgttagtaactctccaaattaactaaacttgttcactttatacaaatttgatcagagtattgattgttcttcaatgttataggattattttcttttctctttaaatcggcttaaataactctgtagagttggccagtattcatcaacatcctggttgataatggcatgatggtgactgatttgtgcccagctaccacacccagggagctgctctctggcaaccattctctctttcttcccttcctcttttcctctctctcctagataagctaccatagggaaactttcagtaggcactgtgaccccatgacttactgtttcggatctaacattttgccctctttatgttttctttctgttattaatctcagtgtggcatagctgtggtggtgtaactaactctcagattgattccagacttcaaaattacataatttggaaaaaaactggccagaatagggagacagggatgggctgaaggaagtgaaattggttccaagagtgatacccctttggaaataactagaagtgtcagggataattcattgtaacatttgatttgcatttgtgatatttatgcatgtaaaatatgagcaaagcaaattggactaaattaaattctggtaattttatattagtcttggttcatctatagctatataaataataatactctttaagtgttttctctattttatgtggagagtttttcaggtattattttcctagtactgaaatgtatcttttttttttttttttttttaacacagctctgaaagattggtattgctggcaggtggtagcctggagatcagtgatgttactgaggatgatgctgggacttatttttgtatagctgataatggaaatgagacaattgaagctcaagcagagcttacagtgcaaggtatgtaaatatttactgtataatttaaaaatcctgtgtactttctgggtctgctaatttttaagaaatattaacatgggcgaggcaatacagcaaaacaattaaaagcataactcctagaccagactgcttgggtttaaattctaaatcttatatttcctagatatatgactataggaaacttatttaatttctctcaacctcattttcctcagctgtaaaatggaaataataagaatatttaccttattgggatgatttgagggttaaaagagctaatacttataaaacccctggaatagtgactaggatattgtgaaagctcaatgttagttattgttgttactatttgtagtggtggtggtggtggtggtggtgacaggaagggtatgatctggggcatctggaagattcacttttcttgtctcaggatgttttctgatgaagacgtctctgttctgtgaccccgaattatttctctcctctctgttggtgtccttttcttttgggtgaacagatcacccaggaaggagtacactgtgcctctcaatataacttggtttgatgatttggtgtttattttcctctcttcatacttctgataatcactgcaagggtagttgttcttcctttttctcctactcttcccttttccccttataggttctttgattcagacgtcagaaaataaagatggcatgactacatagtcttgtttttatccccatttcctgtgccattcctccatatggaaatgtaccctcaagtgctggctagaggtgactaaagtgaccaaaggtcacttttctacctcttcttcccaccccctcaaaactcccagattggtagctttcaacctaggaagactgctcccagtgctgtttctccctaagagttaggagtgctgtttcactcctaagaatgaaactctgaccgggactgttgcctgaggaatgccccacaaattggagtaaatcatagtggttctgaggttcctggggttctttgctcggggcctcagcctcctcttttcttaagttcaccatttagatacaattaagacctggcctttagtgctttcacaaacatatatattaccagagtggttggtacccttgatgcacgttagtttatagccaagctgaacacctgaataatacaattactctcagattggcaaccaagtgaataatgtatgctatctcatagataattactggaaaagactgaccaagaattaaaaataaccataaatatatttaaggagataagaaaaatatttgcaatatgatgcaaaaacaagaaaatataaacacagaaccaaatagaaatattaagaatgaaaaatatactaaaaataaagaataaagcaatctgcatgatagagaaaggtatcccatttttaaattttgttttattttgattttttttgagacagggtctccctctgttgcccagcctggagtgcagtggtgcagtctctgctcactgcagcctctccctctgtcacctaggctggagtgcagtggcacaatctctgctccctgcagcctcgacctcctgggttcaagcgatcatcctgcctcagccccacaagtagctgagactacaggcatgtgccaccaggcccagttaatttttgtatttttggtagagatggggtttcaccatgttgcccaggctggtctcgaactcctgggctcaagtgatccacccgcctcggcctcccaaagtgctgggattataggcatgagccactgtgcctagccagagaaaggtataacattgatgagcaaactcatgaattggaagattacattgaggaattctctgagaatgcagcattatatgataaagaaagataacacatggagtaaaatctaagagatacgataggtataggtagaaggactatctagataaataggtgtcttagaggagagaaaggaagagggaaatatttgaagaaataattaagataaatttttcagaattagacttgtagaacaccttagactaaaaggactagtagactgttaaataggtgaaagaaggaaaaacccaccttgaggcccatttacagtaacatacaataatgtataattatatatacagtaacgtataatatcaaagacaaaaaaattctaaaagcttccagtgacaaagagcagatcacctacaaaagaaaaagattggattgtacctaagtgttgatttgagaaatctggtatcgggaggacaatagcgtaatctttttaaggtgttaaaagatgttgaatacacacaatttatatgcatccaaaatgtgagacataataaaaattatcacacaagatctctgaaggtttgctgcacaaagatacgttgaaaacacttttggaataaatactcaataaaagatatacctgggaaatactgcaagagccttttaaaacaaagggggagttggccgggcgcggtggctcgcgcctgtaatcccagcactttgggaggccgaggcgggcggatcacgaggtcaggagatcgagatcatcccggctaaaacggtgaaaccccgtctctactaaaaatacaaaaaaattagccggcgtagtggcggccgcctgtagtcccagctacttgggaggctaaggcaggagaatggcgtgaacctgggaagccgagcttgcagtgagccgagatcccgccactgcactccagcctgggcgacagagcgagactccgtctcaaaaaaaaaaaaaaaacaaaaaaacaaaaaaacaaagggggagttttaaaacagctcccagattctttgactatccttctatagagtggtggggtttatgtccgttgctcttgaatctaggcaggcttggagctatttggatcaatagagtatggcagaagtcatatgtgacttccgaggcttataaaaagctgtgcattggttgtcatacttggagagaatttttttaaaaggaaaaaaagaaaaagcagtgcggatttttcctggctctctcgatgctaagaatatacaatggggaaagcatagtctcttcagtagatggtcctggaaaaactggatagccacatgtgggagaatgaaatcagatccttatctcatatatgtaaatcacatatacaccatacacaaaaatcaacccaaaatggattaaacacttaaacataagacctgaactgtaaaactactaaaagaaaagaggggaaaagcttattgacgttggtctttgcaaagaccaacgtttttttggatatgaccccagaaaacacaggcaacgaaagcaaaaatagataaattggattgcattgaactgagacgctcctgccagtaatggaaacaatcaacagtgaagagacaacctatggaatgggagaaaatatttgcaaaccaatgaaaacagaagaagaaaatgataacaagagcaaaaattaatgaaataaaaaaacaaacattcaaaacagagaatgtcagcaaagccaaaagttggttctttgtaatgcataacaatattgataaatccctgggaagacatacattacttgacagagatctttatctagacccggggttggcagagtacagcttgtgggctaaatcttcctgactgcttgtttttgtacagcttgtaagctaaaaatagtttatatatttttaaatagttgaaaaatatcagaagaataatattttgtgatacatgaaaactttatgagatttcaaaatttattgttcatgcagtcttactggcatactgccacactcattcatttatgtattgcctatggctgctttcatgccactacacaggagttgagtagttgtgacagagaccatatggctcacaaagcctaaaatatttactgtctggctctttacagaaaaagtttgccaatccctgatgtaggttttacaaagaactcctacagatcagtaagataaacaaagacagaaaccaatagaaaatgggcaaaagacttgaacatcgacctggaagaagatgtctagctagctattaatatttgaaaaagtggttgtcgttattagtcttcagagaaatgcaaataaaaaccatagtgggatatcactgtattccactataatggctaaagttgaaaagctcaacaaataccagacattggttaggatgaaaaccactggggactctaatgtactgttgacaggagtatacactgacacaatcactttaaaattctgcttggcagaatctattaaaaactgtacactggctaggcgcagtgactcatgcctgtaatcccagcactttgagaggctgaggcaggaggatcacttgaggccaggatttgaagaccagcctgggcagcatagtgagaccctatatctacaaaaaatgaaaaaattagctaggcatagtggcacacacctgtatttccagctactcaggagactgaagcaggaggattgcttgagctaaggaatttgaggttacagtgaactacgattgtgccgctgcattccagtctgggtgacaaagcaaaaccatctctaaaaaataaaaacttaaaaaaactgtacacagaaataccctatgatatagtagttgtattcctaggagtatacttaccagaaatgtataattatatgcccccaaaaccatgcacaataatgttcttactgggaataattcaaatctccatcaaaatacaaatgtagagtagtcttccagtcatacaatggcaaattatcagcaatgaatattgacagatcactgctacattcgacaatgtgggtaaatatcacaaacacccttgaagaagccagacacaaaagaatacctactatatatatgtaattacattgttatatataattccatttgtgtaaacttcaaaaacagacaaaactaatctatggttttagaagtcagaatactgattacttttggagaagggcagaatcgttaccgaatgttgcacagcccggcttctggtgtgtttatgttcagtttcttaatctgggtggtagttacaattcaagctgtattgttcatgtgtgccacatgagatcatctctttttttactgtttacagattataactcataatgtgcaaaaacatatttggaaaattttgttttgagccctgtcccataattgaaagcatttatttttcagatagggaaagcagattttgagaaatagttggagagatatatataaatacagtcatacctgtctgacttctgttatttttttaagaagttatagctataggaaatgccatagtgagtgttaatgtagaaaaggttgtaagttcatttttcatctgttaaatgtttcagatttattgtcttatcattaactcctggagtttctacacatgcagtgacgtgaattagcccatcatgtatttcctgtcatctcagattgttgataacacttaaaatgggtcatgagggttttttaaaacagaaacttttcctttttctcttcaaacagttacaacagtctgtgatacacatgtctcccgtgccaccaaaaagaaatttttccatttgtatttttgtggaacaaatggataaattctaaattggctacccctttgacattgtaaatacctataactaatctaccacttaagttttaaacctcactgtctttccttaagccacagcctatgtcactctacttctttgactcttctgctctactcttatccctggccacattaagacattgatctccccttttctctcagtctttgtgatttcacttccctttacttcatgatcagttacaatattctgctgtcattcattagaactcttagttctcttggcttcgggataaaaagcaaattccttatgtcatacatacagagtacatccagatccttcatagttggctttttcagcgttaactggagaggcaccacagaggagtgattgagagcaatcttgccccagtgcgcctggattccagtctcagctctgtctcttagctttgtgaacttggccaagttaattaatttacctatgtctttgtttcttttatcagttgaatgggttgttttaaggattaaactcttttttttttagaagagccagcataaagcacttttattgtaataataaaattggaaactcatatgtgatgttgtggggagaggggcaacaatttctgtcaccagttcactacacaggacatcaaaggagtgacaagggactgaagaaggaaaagccaggaaacgttgagatcagcagagagagtcaagtggcagaaaacaggagatgttgaagctgcgatgacaagcatcatttgcttaacattcaaggatttgtcatgatagctgggctttcattgggtggttaagtctacaaacaacacctttaatttatactttcaattaaagttcttaaaattaaggaagtggtggagcttggaaagttatgagattacaaaatttctgaaagtccattagaaaagccacaggatggggcagaggaaataagccaggccaccaagaaggcttcagaggtccccgctggcccagggacagatacctgtagcatccaacatcgcagtgaaaatgatctgctttcaaaaggcagaggatttcaggggagggtagagtggaactgatggaggcaaaggctccccatccccacctcagtttttggtagggcttttaatttaaccgaaggacatctttcaactttgagaataattcagccctcaagagtgcgtcagatctgctatggctttgcagcgcaacagcaagaatgtttagtatataatagattaaaatttcatccaaaaaaaatttaaaataaagattcttataacctccccccacaacactaaatcctgttctaaagttaaccagtcacttgttctgttaatatttgaccatagacttacttggaaactagatcgaaaagactgaagctgaatcatcaccccaaagtgaaaatgaaataaactgagtaacttaaggcttatggcatatagtttaagtaaaatgagaagaaagaggaagaggaaatggaggtgccagaagcaaagctgagtgacagaacgcattcagtcagggtagatgttatacaggttgtagtggatctacatgtggaaaagctccatatggatttatgtgcatgtgtctggaggcaccagatccttctgtggcagatgtaagaacaggaagccaagggaggaggccattcttgccatcccagtcttagaagctccatgttgaagacaagagtggcatgatgccctggtgcccagtggcactgaaagcatagtctagagatacattcagtttggctctgtgacccacattcatctgggcaacccctacctcccactcccgggtcaccttctgcttgcctagcacacacttaaagggctcatttctgtcctttgaagagtcaaatttctttccatcttaaagcatcccggcttccggaaggtatccaactcctggggagatgatctccaccttcgctcccaggacatcggcggatgccggtgggcaggcagtgtggactgagagggacctgtcagtggttcccaggctctgcctcatccctgctgtccatcatctgcacacatgggcacccccgcacgccccgtcctgcactaggagtaaattcttagcactttccccctaaatctggaatggagatggagtcctctttaccaaattagttttctgaacatactgtgctgtttgatagcagtgttcccctgtgtccccttacttccaactacaatttcctgatagaccctcaagattagtttacttgacccctctgtgaagcttttcttaaccatcccctcataattggtttcttaaaatagttctctttttaccagtagtatttcttactgatttgtttatatgtcctcttcaactcctactagactggagttcttatcaacaggaactggtcttactcatttttaaaaatcatagtaggttattaacgaatggaatgagtgaatgaaactttaaatggaaattgttaaatgtggcaccagaatgatttgatttgatttgatgtttgtggttactttactattcatgttttcctttgcactttgtttttcatagacttctaatgtaaaagaaatgggattaaaagaaaaatcttctgaaagttattctggaggaagatgaaccattacctctacttttatgattgaggtcataattgccaccttcacatgcatacatgtttacaaacaattcatcagttttattcattcccatttttgaccttttgataccttccataagccaacataatattaaaaaaaataactgaagccattaaaggtgaactttcctccacatggctgccatctctgctttaaaaactcttacacatttattactgtcatgattcaaagctaagtgcattgacgtctttaatcccaactccatgagatgctccactactttgacttgataccagtgtgtcatgctgtttctctttttatttctttgcccgttccttttgttttgccttcatgggcatcttttcttccacttgttgattaaactattagtgttccaccgagttctgttgtcagcctgctactcttcacactctacctgcttctggtttcaggtataatttacatacagtaatgcccagattcccagaccagaccccttgtcaagcttcagacatttgcaattggatgtcccacaggtacctcagaaatcgcatgtccaaaattgaacttaacattcttctctcaaaatatttttcttctttgattttctgtatcttgatagtgtcactgcctacctttttacctgtgctagaaacatgaaaatcattcttgattatttcaatctttttattttttttccacattcagttcattagattctctttctccttgctttcactcccctgattcaagtccaagtcatctcttacctatattactgcagtagtttcctaactgatttctctagttctaacctggtctctcctcaaatccattcttcacagagtggcaaaagtgattaaaattctttcattaaaaacttggaaaaatgattgcaatgatataaatggtgcttacaaattaataagaacaagattaatatctgttaaaaaaggggggaggtggaaaacatagtttgcttacagaaatgagatgaaaatggccagttgacctgaaaagagttcaaccccactaattgtataagaaatacagattaaagtagcccatttttgcgtactgattgaattttaaaataataacctactcttggcaaaattatatggggattctcatacactgctggtagtggtacaaattgatgtaaccttggagggcagtttggtaattttatcaaaagctttaaaactcacacattcattgaccagcagttccacatctgataatttgttttgatgaaataaggatgtgtgcaaagatttatgcatggaagtatgcatgcaatgatgtatatttagtggcaaaaattataaaccacttaaatgcccaaaaataggtgattggttaaataaaacagcctacctatgtatcagaatacaatgcttcctacaaaaatcatgttttagaagtttgttaaatggcaagagaaaatactttgggtatattaaatgacgaaaagtaagatcccaaagcaacatgtgagaagtatgatttgtgccacaaagttacattgtaaattgcatcagatccttgactttcttataaaaattagcctcacaccaattaggaagaagctttatgtatcttcctcttgaggccttctccctgtaattttcagaatactggatgtttacttatcttgaaaggatcatttttcttctaagctccaagcagagagagaactggattctgagtccattaatgagtgcatgattgtcattgcttctcaaggtaacttaatttcaagggcaaccactagctacttaaaaacaccatgcagttattttgcttgtactatcacttctgcctagaatgttcctccttccactcccttgcctggctttcctcagaaacctctgaaactctgactcctacctattcctatcccttgtacccttcttccattagctgtgcattaattatgcacatgtattttatacattatctgtcttgttttacgtatcacatttacattttccccccagtttttgtatccagtttctaccctactagactgagttctttgaggacaggactggatcttgtcaatctttagatccttagcacctaatgtagtagtgcctgatgctgtgtatttgaccacaacggattgcttaagaacatattctccgtacttctggataagatgtcagacagtaaattataatccattcttttatagtatgctatctgtattcagaatatttcagaatttcactttataaactttatatttttaaggtattactgtatgttagaaaagtctttacaattgctttataatcctttattggggccttaatcattttggattggtttgcagttcttcttagatttttattgcatcagtggtcatgttagctttgagataaattccacattttacaagcttgaaataatttcctaatagttatgtaaatttattctgaaccacagtagcctcatttccatggtaactaaccaccttcagaagagaactttcagatattctagaaaagaccagaaatatccatgtgaaataaaatgaactaatgatgtaaagttagaactcagatttatgtggagtacagatgcatgatattggaccctgaaaatgttgcagatagaagagccgttcaaagacctgaagattctgcctgtttgctgtttgtacatcaggcaaaatgcaacctaagaaaaactcagctgtattgtgatttttgttactaaaatgaccccaatgaggaagctttgtgggacaaataagcaaaattcatggtgcagaaatggatttgtggtgccactaagagattaacattgtgcttcacagaaggaatgtggtctcatgaaaggatatatggtttttggaagcatatccctgatttcgagcctctggcaatgtgatcttgggcaaattaatttatttacttgaacctcattcttcctatttgtaaagtagggataagagtccttctttgtggtggtgttgtgaggaatatccttgatacagtgcctggtacattataggcattcagtaaatgtacctcagctaatgttcccagggctcagagaatctttcctttgtaagactccttcacttgattctgttgtctttgatttcttttttgccttctaaaggattctgtttcctccttagattatttaaattgacatctcagataactttctgtttgcttttgttccatgccaccagccatccatcagatggcaccatgttttgtggtctttgagccaagccagtcacaccccattcctcatgcccagtctagcttcttaggctttctcacctaagtctgtgcttgctgggctcctgcctatctaggacaacatgacaaaatactagtaaatattcttcattctttatttaaagagcataacaattgataatacgaggacaaagtcatgtcccttccagcccagaagtaagtgaaaagatttgactatcattgttggcattactctgcttcttaggttatctgtcttgatctcagaatttcaagcattccttaataattagcccactctgggtctcttatttattaattttaactatcttttcttggatatatattcttttattgtatatattcagttttattggtggaatgtcttttttttttttttgagacaaaatctcactatgtcgcccaggctggagtgcagttgcgcgatctcggctcactgcatcctccacctcctgggttcaagtgattctcctgcctcagcctcctgagtagctgggattacaggcacccgccatcatgcccggctaatttttgtagttttgctagagacgggtttcaccatgttggccaggctgttcttgaattcctcacctcaagtgatccacccaccccggcctcccaaagtgctgggattacaggcatgagattatactgcacctggcaaatgtttttcatgtagtatttactaccttatttttattgaaccatatttcttctgccttaaaggggtatcatcaaatctacaagctttggttaagagaaccatgacaggaagaatcttagtaattttaattatattgtcagtaagcttcttgtattaaatatattgaatctcttaaacttcatttaagaaattcccattctcctcttcaattttagttaggttcccctttcttcattaaagagatgatagaattaggaacagcaggaaaagtggagcagttttataatttttttaaatgccccctttcttgctaaaaatcaaactaaagagctccaaagtgggcagtggaaagataatgtcctagtgaaaagaatatctaaaacaggtttcttcattttgtatttcttcccccgctacctatttctacccctaactgttaagggtgtattgatggcactttcatataaacccagtttacacacaggaatggggtcttaccccatcaggtccccacaggagcattttatatcagagcagcacagttaccctcagtttatctgaaagttacatgcattgaatggtgatttaaattctgagaataactgacaaaaagctaaatgaatctaaattattctactttttcccagtccctattgtaatgataaccaagatttctttggtcttttttggccagagaagtctcttaggttgaaatcatatcagtggttttcaaacttgtttttttttttttggccagggaactcaagcaaaatcataattggaagtgagatatttaaaatagataaacatggaactactcagatggaagcagggcagggtaggaatagttgccacacccagaccctccattccttgtttagatttttttcttgttgatgatttcaaatacagagttttgtccaggggccgtagctcatgcctgtaatctcagcactttgcaaggccgaggcgagtggatcacgaggtcaagagattgagaccatcctggccaacatggtgcaaccccgtctctaccaaaaatacaaaaattagctgggcgtggtggcaggtgactgtaatcccagctactcgagaggctgaggcaggagaatcgcttgaaccctggaggtggaggttgcagtgagccgagattgcgccattgcactccagcctggcgacagagtaagactcggtctaaaaaaaaaaaaaacagggtttcagtgaccatgttaaaagtaacagcaaagatacttttcaaacactatttattctgtatctactgcaaataggcagaaggcagaatccagtatcactggagatacaatgacatatagggcacattctcatcttcaaggatacagtaggtgatacagagaagtagttagacatttctgtcccaggatgataaaaactataagattacgtgtcaactatgtctttgagacttattcttgtccaggtgatttcagtgattcttgtgcagaaagtagaaggaaaaaaaagatacgatatttttaacagataaatttattctttgaattcttaacatcacattatgaattagaaatgatagtacatctaaacatttttaaaatatttaagaaatttttaaattactacataatatttgtacatatttgtgggatacatgtgatattttgatacatgcattcagtatttaatgataaaaatcaggatatttgggatttctatcatctcaaacattgatcatttccttttgttgggaacatttcaaatcttctagttattttgaaatatatagtatgttattgttaattatagtcaccttattgttgctatcaaacacagaaacttatttcttctatcaactgtaggtttgtacccatttaccaaccttcttcatcccctctcaccttgatctcttgcccagcacacacacctttcccagctcctggaacctgtgaaagatctaattcagtaatgatcacagacctaaatagtttgtagtttcaaagcagaatttacatggactgaatttgacttgtgaactttgaaatcctgagaaatgggtcagatggttgttctgtgccattttcaaaaccaaatcattttgtaagatcctgctgtctgccatcctttttaaatcatgttttacatagtatttttttaaaagaactatttttcagaatacagtgcttttctcctttttaaaaaatcttaatcatagtaatttcccaataagaaagcaaaggtggtaaagaatactttttcctaaggaaaaaatattttataattgttttcaacatttttttgtgttagacatttttcataataaaaagctgaaggaattttacagcaaatacccaccaccttcagtcttcagttgacattttactgtaatgctgtatcaaatatctatcattatattaatcaatctaaattttttgttacatttcagagtaagttgcagacatacccagatccttaagcattcatatcattagctaagctttaatattttgtttgcagtttttttctctttcgaggtaaaatttatatacagtgtaatgcacaaatcttagatgtgctgtttatgtgttccagcaaatacacattactatacaaccaaaacccatattaaaatataaaatattaccaccactgcagaaagtttccacattcctcttctcagtaaatcctctgcttactaccccagagggtctattcttttgttttttattccccactataaattagttttgtctgtcctaaagcttcttataaaagtaatcatgttgtctgtgtttgtttgtttaaggcttctttcacaaagcataacgtatttgaggtccatccatgttgctgcttgtattagaaacctgttcttctttgttaatgagtagtatttctgagtagtgtatgccaggccttttcccagagtggtcataccagttcacattcctaccaacagtgtatgtgagttctggttgctccacattctgacccacatttagtggtgtcagtcattttaactttagtcatcctggtaggtgtatagtagcatttctatatggttttaatatgcattttcctgatgagtagtgatgttgaatactttacgattgcatattggctgttctggcatcttcctttgtgaggtattttctaaacagtgttgatttcctgggtagatggtacatgttatagacatattaaaactaattcttaaagtgttctgtcaggaaactgtctacttattgatacctgaaaatagtggacaataaaaaaaattgatataatttcaagcctgttttacatgtctttagaaatagttgattttagctattatttatttgtgagtttgttctcacactgctatgaaggaatacccaagactcggtaatttatgaaggaaagaggtttaattgactcacagttctgcagggctagggaggcctcgggaaacttagaatcatagtggaaggggaagcaaacatgtccttcttcacatggtggcaggaaggagaagtgccaagcaaacccttataaaactatcagatctcgtgagaactcactatcatgagaacagcatggaagtaaccacccccatgattcagttacctcccacagggtctctcccacaacatgtggggattatggaaactgtaagtcaagatgagatttgggtggggacacagccaaaccatatcagcttctattttgattattttgggatttgaacattttctccatgtaaccatttgaaattctcttgaagaagcaaaagaacaatctcatgtgctgtgaaatacctgttatttataaatggattctaaatatttttggccacataaactactggttcagaatatctgtgcctttagtaaataattgaatttgcctattgtattagtcagggttatccaaagaaacagagccaataggaagcataagttttccatataaataaataaatacataaatacatgtatgtgtggtgttatgaaatatgtatacatatattggttttcatccccagttcctggcgcatatctcccatagcctttgttacagtcttctcttatgttgggtatgttaggcctcaggggcaggccttaggaaacagaatctctctgatcttctcctgccctcctttcacctgccccaaggctctaatcttccccagcctttctgatggtgggttttaggacccttcccaaagaggggcccacctcatatgctggaggaaagaatactgacatcatgaagctttcataaaaactcgggaggagtgggttcagagagcttctggatagctgaaaacatggacgctcctagagggtggtaccccagggaggacatggaagctctgcgcccctttctccctacctcaccctacacatttcctcattgtatcaatgtcctttatattaaaccagcaaatgttaagaaagtgtttctctgagttctgtgagccgctccagcaaattaattgaacccagagagggagtcctgggaacctccacttgaaacacattggtcagaggttctggaggactaggcttgtaaccggttgggggtgggaggaattctggggagtgagccctcatcatgtgcaatctaatgctgtctgcaggtagatagtgttggaattgaattggagaatacccagctggtgtccactgctaggtgtgtgggggggaaactcccacataatttggtcacagaagcgttcttctgtgttgatgattgtggtggtgtgagagtagaaaaaaaatgcagcttgagagggtgtttttgaaactgtgggtgtatgtttagagaaagagagaagagacttttattataaagtattggttcacgtgattatggaggctgagaagtcccatgttctgctgtttctggagacctgagaaagccagcagtatagtttgaaggcctgagagctggagagtcagtggtttaaattctgctgtgagtctgaaggcctgagaaccaggagtgctgagggtaggagaagatcagtgtcccaactggaacaggcagaaaacaatttcagcctttttgtttctcattggactggatgatgccaacacacattgagtgccatctgctgtaactcagtccacagatccaaatgcttttctcttctggaaacaccctcacagagaggcacagaaatagtgagtaaccagatatctaggcatgccatggcccagtcaagttgacacataaaatttactgtcacacatagtatactcgtcttcatctaattacaaatagtttaaaaatctaattacaaaatctaatcactgcattggcaaaacaccatttctccccaaaaccctggagaaatcttcccatgcttatgaggtgtaaattatttgtgaagcattggccctacctgaaatctgggtcaaagggaactacagatctagagcatatcacaccagtgtgttaaagtgaaaaaataatgtaagcaagttatattggcgaaagtcgttattgtcagccccttattctgggattgtaatggttgatttccaatgattacgtaatataattatactttaaatgtaaataatgctttatattattgagggtctaaagggatttaatagataaagtgcacgttacaatacctgacttacatctgatactgaacaaaatttagttctctcttgtaaaaccctatgtagaggtattgttattagtccactgactgataaagcttctgaaagcctccgaattatattttcctctttaaaccttatcaaaaatagttgttccattttaaaatactgcaagagttagggtagtagaattatgaggcattttgacttgccaagaaatttaattatagtagaaataatatcaagcaatttttattttatttccaaggtataatttatactgtgtcacatttacattatatggatatacctgacaaatttttaaaatatctttcatattaacaagaaagtattttcacatatattaggtcttatgtccttttaaggaaaattgatttccctaagattacaaaacacatttggaggcaaagcccagattaaaagctcaggacttctgattcctagtctagtattctttaaaaaaaaaaaaatttgtaatagttggtgtatatatttatcgggtacatgagatattttgacgctggcatacaatgcttaataatcacatcagggtaaatggagtatccatcacccaagcatttatcctttgtgttacaaacagtccagttattctctcttaattatttaaaaatgtacaataaattattgttgactgtagtcaccttgttttgccatcaaattctagatcttattaattctaattatatttttgtgctcattaaccattaccccccacccactacctttcccagcctctggtaaccatcattctactctctatctccatgagttcagttgttttcatttttagctcccacaaataagtgagaacatctgaagcatgtcttctgtgcctggcttatttcacttaacataacgacctccagttccattatctgatatgagcgtagctagtcctgctcactttcagtttctcttggtgtgaaatatctttttccacccttttactttcagtctatgtgtctttacaggtgagtttattgcaagcagcatatagttgaatgaagtttttaaaattcattccaccaatctatatcttttaagtggagctcttaatccatttacgttcagcattaacattgatatgtgaggttttgatcctgttacattgtgaattgttttctagttgttttataaatttgttgtttcttcttctgtcttttggcttgatggaattctgttgtgttgccatttgattcctttctttttctttttttgtgagtttgttttataaagtctttgtgtttttttttttaacttgtgttgtcatggtggtgaatgtcaacctttcattaccacatttaggtctcctttgagcatttcttatagggctggtttggtggtgataaattttctcagggaaagactttttctgggaaagaatttctccatttatgaatcttaatcttgctggatataaaattcttggctgatgtttggtggtggtggtggtgatactgatggtggtggtggtggttttccttactgcactttgaaaatgccagctcattctcttctggcttataaggattctgctgagaagtcaactgttagtctgatggggttttctttataggtaactagatgctttttttcttgctaattttaaaattctttcttttactttgactttagacagtctgattataatatgctgtggtgcatattccaagtcctttttggaatatattttcctcaggatctctaggcctcctctatgtgaatgtctaactctcttgctagacttgggaagttttcatcagttgtttccttaaataggttttctaaactttctgatttttctttcccctcaggaatacccgtaattcacaagtccagtcactttatgtagtcacaaacatcttgaagtctttgttcttttttattctttttaagtttttgtctgactggattatttcaaaagacctgccttaaagttctgagattctttcttctgttcaggcttgtctattgttgaagctttcaaatgtattttgtaattccttcaatgaattgttcagttctagaatttgtttgaagatatctatctcgataaatttctcattggtatcctaaatagatgttctgacttcttggtactggttttcagatttctcttgcaatctcattgagcttctttaaaatcagtatttttaattctttatctagaagttcaaggatttatttttggttaggacctattgcgggagaattattgtgttcctttgaatgtgtcataatatgttgctttttcatacttcctatatctttacattggtttctgtgcatctggagtaacagtcactacttcttatttttgaatttgctttcattgagtggggagactttttattgaagatatgtctataatgttgattggatagggcgttttggctttccttctgggtatgcgcagtggctttaaggattctgtgtgatttccttggctacagatagccttagtgttaaatctgtggatttttctgtgtgttagtgtgcagttattggtggagtctgtgatgaggttttgctggagactggaatgcctcatgggtccttcagtggtagtggtggtgggctaagtatgtctatcattgtgacctggtatgtggtatatgctggcacccatgttggtagttccaggtaggctgattctttggccactgggtggctctctcaaatgcctgttgtagtagaggtagaccatgcaggtgagcagactcttgacctactgggaagccagggtggtatgggcaatgggaatagcagtagtagtgagaagctcttctcattcacaagtgttgtgcccttgttttatcagttgttgcaatgggctgtgcatgtcagcctccaggccagtaggtggcacttgcaggtaatagccagctatattgtcaacagtaggttttatgcctaacctctgtttctgaggacaagtgcttgcacaggtgtcccagatggtggattgagttgcagaattctcaggaacctggatccccctaacctccacttccctctgcggagtaggggccaagctgagtggagctggagcaggcaagcttgtactcaggcctcccaatggtgggtgcatctaccttccttgacgggggtggcagggcagttctcaggcccctggtgaaattcttgggtgagggatgactgttgctatgccgaagtcttaacatgggtatggaggggcagtcccagcagccacagatgtggcttgtgtaagtaggacttacttccttctcatgccccagtcctggcagagttccctcccactcctaactgtggcagcagatcagcctgttcagtcatggcagtgttctgcaactcagtccagggccttaggagatacaacccagcttaatcccaagcctccatggcagctctcctcctgctcaggtcccaagcaggtagggggataccccagtttcagtatcagctgcccataccagtttctcagttctggttgcaggagtccagactcttgcttgagtcccagttcttcaagccccagcccgaatttctgacaccaaagcctggcactgccacttgttcccaggaccatccacagcttgttaagagctgggattgagaatggcctcttactgtagctgcctatatctgatggaatgtatgggacgtccctggagcagttccttgtccagtcactccccaggtgagatccaggattcaggagggtcaaggtgctctcctacagcctggattgtacaattcccctgtggaaacatggactgcagaaatacactcactcaccctctcccctactggggatacattcctgattttcagccagtcctggccacacgggttacctgttttccttcttctcagatgttgaagtttccttttgcttttctcttgaactcccatgctccctcttggataatatatttaaagtgtgattgtctacacacaatttttgttcttctaagtggatgagatatgctggaaatgcttctactcagccatcttggagagaaacttgaaatttctgaagttctgtagatcttatcctaactctgttttattgaaaactttaacaattcctacatcaatactaatactgtttcccttgttgatattttgttggaaggatcccttctcattgttcttttaaaaaaaaaattgtttttgaccaaatgtggtggctcacatctgtaatcccagcattctgggaggctgagacaagaggatcgcttgaggtcaggagtttgagaccagcctggccaatatagtgaaaccccatctctactaaaaatacagaaattagctggcttggtagtgcatgcctgtagttccagctactcctgaggctgagacaggagaattgcttgaactcgggaggcagaggttgcagtgagccgagatcgtcctgctgcactccagcctgggagaaagagtgagactctttttttttttttttttttttttttacaattttttcttctagatggcctgcagattcagcttgttaaatttgataaaatttctcctgggatattaaatggcatttcattgactttacagattcatttcaaaagaattgtgattgatatatttacagaattaagtctttgtagccaggtgtgtgtgtatattattattaccatttttttgagacaggatctcactctgttgcccagactggagtgcagtgtgtggtcatcgctcactgcagccttgacttcctgggctcaagcaatcctcctgcttcagcctcctgtgtaactgggaccactacgacacccagctaatttttgtatttttttgtagagatggcgatctcactttgttacccaggctggtcttgaaatcctggcctcaagcattccttctgccttggccttccaaaattctgggattacagtcatgagccatcacacctgtcctcacttttatttttaattaaatatttttaatagataacatatgaagatgttctagaaaggatatatagtgaaatattactgctatgtcccagccctcctccacagaagcaaccattatttttttcttatccttctagagatattctatgcctgttcaagcaaagaagtgtgtaaaaatagcataataggtgtaacaagcaatcttagagattgtcatcatcaggagcagatccagcttttttgaggtctgcagtgaaaactactttggaggccttgtttaagacagtgagtagcgaggtgtggtaatacacacctgtaatcctagctattcaggaagctgaggcagaagggttgcttgagccccggagtttgagttctgcctgggcaactatagcaagattctgtctcaaaaatttttttaaaaagacagtgaataccaaactatgtacaaaatgagtagttatttagaacgagaaaagaaagcacaataaactagtttttcaaagctgataaacactacaaacgttaccaaaacccagaaaaaacagcactttaaaaatattaccttatacacgtatgtgttgtaatatttgtttttgctgcattttgtttcattgtctcctcatatgtcagtgattttgtaagtcattttctatgaaaatagaaagctaatttggtcttttcctccagtgtttaagatatagtcatttgaatatgactccacacctttgtgtctcggtgttgggtcctgttagtacagtgggcagaaggagtattcctggaagtcttcctatactgagacagtttaggtatacacaaaagttttggcgaaaaccacataaatatatcccactaaacccactaatggtatatgtagctcaatttcctcttgacttctcttaagtacaaaaatgacttcagccactccatcatgacctggcataagggcaagtcaacatggaagcagcagcagtcttgatggactgtggttaaaatagcttactatttggtggttcctaatcttttgctgcttcagtgttcagggaatatccttatgtctttatgcaaatgtgtgagtgtttctgatagatgaatctcttgaggtgaaattgctgtatcaaagagtttatacaatttagatttttatagatattactaaatcaccctataaaagattgtatcaatttatatcatcaccaatatatataagactgcccgtttctcatactcttgttatttgcatattacttacatgagtgaggttcaacatcttttctcatatattaggaaattctgtgtattttcattttgtgcactgtctatatcttttactcagtttttatttgtaatttttttcttattaatttgttggaacttgtatatattagggaaattagttctgttatctgttttccccctgttcattgtctttttacttcatgatagtttttaattatgtatacttttaatttttctatgtagtcctcttgaatatacaaaaaccccaaaacaccaaactgttgtttttcctattctctactttctgctcaacgcagaaaacctctgtgatcccagaatgtgggggttatttccccacacaccaagcagtacttcagtggacacctgctgtatgtcctataattcagttcagttctgacactacctacctttctatttttctaatagaaacagtactacttactaaataccgagtttatttcatatgtatattcttgcctcctcaccatttccatgtagagatatggcactggagagagtgtcatatctcacaggttgagagctcaggaccaccagactaccatctctcttcaggtggtagtcccaagtctgggtctccagaacttctgactgactagctacagattgaggttcccatgatccccttgttgggttttattaatttgctagagtggctcacagggctcagggaaatgcttacttaaatttaaccgtttattataaaggatattacaaagtgttaaacagcatagggcaaggtacgtgggaaggggcatggactttccatgtcctctctgggaaccacccttcaggaacctgcatgagttcagctacctagacgctctcccaaaccctgtccttataagtttctatggaggtttcattgtgtaggcatgattgattacatcattggccactggtgatcaattgaaccttgagctcatctccccttctggagtttggggaatggagctgaaaattccaaccctctcatgtttgattccactgttaggtagccctcatctggaggctatcaagtaccccatcaagacttgtcttattataggacaaaagttgctcctatcacccaggaaattccaagagatttaggggctctgtgtcaggaaaccaggatgaagtccaaaggcagatttcacagtatcacaagccaatatgtttaaattttcttttgtgacttccgagtttgtgtcatacttagtcctccctccaagattatattttttaaaaatctcatgtcttctagtgcttttatggcagtgtttggttttaatcattaaatttttgatacgtatggaatttactttggtgtaagaaatgagatacaaatccaacattattctttccaagtgattacagtttctaggattttttattgagttatgtatcttttccctgatgtaatgtgtcacttcaatcgtatgagaattttcatacatatttgcatctatagttgtgcctccatttttttatttgaatagaaacagtgctacttattaaaatgccgaggttatttcatgtgtacattcttgtctccccaccatttccatgtctgaccactgctactactgtgtcctatcataacattccatatatgcttaaatccaagcaaagggtggatttccatctttaaaaactaagcaggcattttggacaacacattcttggcagtggaacttggacaacatttatcaaacatattagggaaagttctcactctacattataaaaaggacaactgtatatcaaatgttacataagtgaaataagatggaaacatttttaaaactgcttaaactattttcttaaagagactttctccactgccagagatcttgaattacctcctggtcagtcttccagaagcaattctttatataattgacgaacttggcttccactttgggaagaaaaccagctttttctgtacttccttgctgttttgctttaatgtcttctacagaactaggttctcttggtgttttaggaagtttgtttgtttttttttctcctgttttttgaaggattcttgatcttggtgttgatggttttgaatcttttccattttggtttgatttttgtgcatttttggctggagtgtctcatacagatttcttcagtggagcttattcttgtctcctcttcctctccacaacccgggtaaccttgctaccacctccaggggcagatcactttccaaatgtacctaagagtttcatgtcctcctcttcttgatcttctaagcctcttcaccttcctccccagctcctaagtgctgttacctgatatgcacaggccctgaaccatacttcaacccaaaggccatgggtggtgttatttcaaagaccccaagggaaatcattggctgttcaaatcatcatgttcaaagttgccactattactttatttattttgttttgttgttgttgttgttgttgttgttgagacagagtctcactctgttgcccaggctggagtgcagtggtgtgatcttggctcactgcaacctccacctcctgggttcaagcaattctcatgcctcaacctgctgagtagctggggttataggtgtgcgtcaccatgcccagctaatttttgagtttttgtatttttagtagactgggtttaatatgttggccaggctggtctcgaacccctgacctcaagtgatccacccacctcggcctctcagagtgctgggattacagatgtgagtcatcatgcctggccagttgccagtattattttaattggactgccttcgtaattcattgtctctgtgtcaacaatctgcagttcatcatttgcaccagcctctaagctgaccattcttaaagataactgatgctcattttcatcattatccaccttaagatggtaatgtttgtcagcctttggttcacaatgaaaaacatggtcctcaggcctcaggggctcatgttcatgtccattgaatcttccatggggtggtggcacacacttaggtgggagagaaagcagatagaaatgaacaactattgcttaagagaacagccacacaggatggaatcaaaccaggcgattctttaatattttgtttccttaataaaattacatatttttcttcctaaaggttttatactttacttgttaggtacgtatctattttattgtttttgtagttatgaatttggtttttagatttacattttctgatttttttttgatacgtaagaatgtgaatgacaacaaaaaacatgttaatcatttattctgctagtttaccagagatttatatttcattctaatagtttttcagcttattcttttggcttttatttttcttttaaaaattatttaagtaatgcagtaacattattaaagaatcaaaccgtatcaacaaagtaaacctcctcctttattgccccttccccattcccacccctttcctcagaggatgactgttattagtttagtgtgtatgcttccaggtgtcttcaaaaagcatttacatacatgtacatctacaaataaatttttttcattagcagatattatatcatctagtttgctctgcaaattgctttttgtcattactgtatttaaatttctctctgtttgtacctacaggactataatcagtatttaaatgccccaaagcgatgtttatcaaactttaatgtacctgcaaaccacctggagatcttttaaaatgctgaaaccgattcagagggtttggggtggggaaacagagattctgtatttctaataagctcccagatgttgccagtgctattggtcctatactacactttgattgggaaggctgtaacatatgctttagacctattgtagtttgtgtaattattattcctgttcatgaaatcattggggtccctccccactacagatagtacagtaatgcacattggaatttctccaggtgagagagattttcttgaatattctgagtagacagtcattgtcatgatgtgtgtgtatgtgtgtggtaggggccggtggtggatttctccaacccttttcccgtatttgtattttgtttctttttcttattttttttttttttcttattttttttgagacagagtctcactctgtcgcccaggctggagtgcagtggtgcaatctcagctcactgcaacctctgcctcccatgttcaagcgattctcctgcctcagcctcccaagtagctgggattacaggcacccaccaccacgccccgctgattattattattattggtttttttttttttttttgagacgaagtcttgttgtgtcacccaggttggagtgcaatggcacgattgatctcagctcattgcaacttccacttcctgggttcagtccattctcctgtctcagccttccaagtagctgggattacaggcacatgccaccacactcaggtaattttttgtgtttttggtagagacagggtttcaccatgttggacagggttgtcttgaactcctaacctcaagtaatctacccgcctcagcctcccaaagtgctggaattacaggcataagccaccacgcccagcctctttttcttatttccttaaattagctaggacgtgcagtagaatgttgaatagcttcatcaatagctactctctgacaggaatatgaaattggtacagcctttggtaatatttaccaaaatgtaaaatacaaaaacaccttgacttagttattccctttaagaatctattcttctaaaacccttgcacatgcatacaaagatatgtacaaggatgcatattatagcatttacctgtagtagaaaaatgaaaagtaaccttaagtgtgcattaataggagaataattacattgggatatggtcataccattgacctactatgctatatatgtggctacatgtatactaatatgcagtattattaagagagaaatacaagttgcagaaaattagttattggttgactcagtctgtattttattttattttttagagatgggggtcttgctaagttgcccaaattggagtgcagtggtgtaatcataactcacagcagcttcgaactcctgggctcaagcagtctcctgcctttgcctcctgagtgactgaaactgtaggcatgttccacatgcctggccaattttttttttttttttttttgtagagataggggtctcactatgttgcctagactccagtctgtattttaaaaacaagttaagtgtgtgtgtatatgtgatgtgttttaaatacatagaaaaatgtttggagagttcacacaccaaaaatatgaatagtatttctctctaaggagggtactggtgttgacaggtagtttgaagcttgataaagaggaggcttttatgttttctgtgttctgtacaccttttatactgagtacttttcaccttcttaactttgaaaatgataaaaaggaaagtagagagatggagaaaataaagcaaacaatactgtcagttaacagaaaaatccaactgtagaacagtagggagaatcagagagcaggtgaattcaaaccatccagtagtcaattttcttaaatagtcaacaagcatggtaaaaaatcaaatggtacaaaaacatatgtggtactgttacagtcctgccaatgcaccacagtgtagcaatctcttgtgagatatcacctggagttcagagttctttgtctcagtgatgaagagaattaaggggcgtggacacaaagggtgaggttggaacaaaagtttaataagtgaaagaagacagctctccacagcagagagaggacccagaagaggattgccgtttttacagttgaatgcaaaggctttttaaaagaaaccagtgagggctgaacatctcatttacgtaaggtgagaatttctgatagctctacccagtcctcctaatgtgcatgcaggcggttagcttgagttattccatatcgctttgttccccttactgcacatgtgtcaggagacgggattttccattgtgggcatgtctgggcaagtcacctgtgtagcctttcttatctgtgtggctgtggacatgtcttaggcaaacctccctgtgcaagttcccttatctgtgcctgcagcttgatttttcaggttgttctgtttgaaataattccactgaggacccaccctaactgcctaccttaccggtttcttcctttctcctctctcagtactgtgataccacccccatacctgctatagtggcttctctctaaaaacagaaaatagcaagtgttggtaaggatatggagaaattggaacccttttgcacttttggtacagcgaaaagtatagttgctggtaaaaagtatggtggcgccttaaaaaatgaaaaactagaattaccatttgaactaacagttcctcttctgggcatgttaccaaactgaacttcggtctgcccacccagtgcagcaaagctaaacactgacatttggattgctgcaaagagaaatggagatgtttattgcagggcaccaaacaaggagaatcggatagctcatgcttaagacctgaactctccaatggcttgcaagcaagggtttataaaggcagggggaaatttcaggaaggtagaagttataggcaaaatcataaggcaatacatggaggttatacattggtttggcctaaaagggcgggagatcttgaagtggggtttacaggttgtaggtagattttctgatttgcagttcattaaggaagagaagttttgttttaaaatctggggatcagcagaaaagaatattagttctggctcatgggtgtgacttctcccaagtccctcaggaagaactttaggacaaagatattcagtcctcagttcccccttacctgatgtgtacatgccaacagatccatttggtggggtccaggtttctgaaaaacaacccagggacatgtgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacttggacacaggaaggggaacatcacacaccagggcctgtcatggggtggggggaggggggagggatagcattaggagatatacctaatgtaaatgacgagttaatgggtgcagcacaccaacatggcacttgtatacatatgtaacaaacctgcacgttgtgcacatgtaccctagaatttaaggtataattaaaaaaaaaaaaaagatgttgcctttagtttctatagggaaccaaacatcccacgactctaacttccttggctattgttttaagctgctattaccctcttgcttatcaagttgttcatttgcttctcagggccagctaggtgcctggaacttctcttgaaggaactcaagattttcctttatttccatgctgggggcgggggaggcccataggcccctcaaggggttcctgctccatctgaggtccatgttcaaaagaattgaaagtaggtctcaaaaatatatttctacacccacattcacagctgcattattcacaataactgaaacatggaaacaacccaagtgtacgatgatgaatgaatggatgttagatgttgtgtatacatacaatattgagacatcaagcaaagattaagtatgtttaactttgttaaagaagtggagcctatatttaataaaggtttttgtgaatttttcaaaataaaaattgatatatagaatacaatttttcaaagttaagagctttagaccgtaagacccaaagtttgaggaacattgcattacaattaaatcatgtgatcacagagctaacatgtaaacatgagcacaaatgttggtgctgaaatttcatgttcatgaaaattttacatcatcataaacatttaaaagcaaaatttaaaattcatgcagaaagtcagacactcaagagtggacttaggagaaacaatgatataaaacattgaattcttaagaaacttgagaatccttgaaaaaaattctactaatatgcattgagcacctattttggtttaggccactgggatttcaatagtaaatagggcagtcaagggctagaaacaggaaagagtgagggactgtgtgtcaggaaatgcttctttaaggaagttttttgttttgttttgtatttttgagatggagtctccctctggtgcccaggctgaagtgcagtggcacagtctcggctcactgcaacctctgcctcccagttgattctcctgcctcagcctcccaagtagctggaattacaggcatgcaccacagggtccagctaatttttgtatttttagtagagacggggggtggggggggggggtctcaccatgttggctaggttggtctcgaactcctgacctccagtgatccacctgacttggcctcccaaagtgctaggattacaggtgtgagccaccgcgctggccgagaaatacttttaattagtatcagatggatgagtacctgttagctaaattgagggctagggtaaggaaaagacaatgagactaggggcaggattgggatgaaaggagagaaatataatttcatagtcaagtggaaacattgttataatattacttcaaacttacatcataagttaagttatgatgtcacctgtttctcttggagaagcctattcaccttcattggaatgggaagctttctcaagaaatgtcagaggattcaaatatattcttgctttgttagttgagtcagtaccaatagtacacttgtgattagactgtcaaacaaaatccctgaagggatttcacactgttaaatgcttggtttttatttgtttttatttgttgggtttttttttttaaacggcatagatgtaaatttgtgaattacagaaaagaagcagttttaacatgaaatggacaaaattgatttctttctctgcttacagagcttaataagaatttcagtccataagcctttcaaatgaaacaatagaaactccaacaattcagagctaatgtaaatgaaaacggttatcttccaaatcacagcataataaagtaaccttgaatcattggtgttggccctatattgttatttatttgaattaaatggcaattttcagcattatgtaacagtgatggaattaagtgatgtttctagtaaaagaattttgcaagtataatatattttagtattaaattccacttgtacatttagcaattaaaattattcctgaaatgatgatggcatttgaagggatagggagctgtcaaagaggatttgaagcttaattatctctttggtaacaaaatgcataatcttccattacaacacttattttcttatggtaattgactcatttgttctctggttatcaatttaacttcccaaccacaaacatctgctcttacaattgtgtttaattggtgtgaatactatctacagagtagttaaaatccagaaaacattttaagggcattattttataattcatgaaagggaaactaatgattaattgaacattgcttatgatgattttttctaatagtctgtgaaagtctgtttactaaaaatgcataccgaaattatctgctcccccctcctttttttttttttttttttttggaagaggcttttgctgtgttttccagagtaattatttactctgccttagggggagcctcagttcttgcagttctttagactcaaggaatatgttaatgtcttggaacatggtaccttagtagttaagagtataggctttgaaggtagaaaaaaattagtatgctatcatttataatctaaataagaggattggggacaaattgtgggtgtgggtatgtgcttataattttcataatggaataataaatcataaatttaccagtagggtaaaggaggaaataggatgagagaaacagggttagaaggtaggtaggtttgtttgaatgtaccttgtctttatagatttaaaaatttacaaagtagttcctgaaactggaaagtaaaatgaaacaggcgactccaaaggtgtatccagttggtaatacagccacacagtaagttacaattctaagtatatggaattataattccatgtaaatttaaaattgtaattggactataatgtacctagtgggatttactctaaggacacaactgcaaaaaatctttggttgttttcttttatcatattgttggtacagatgtttattctgagactatgggtgtaggataaagtaaatgagtaattatgttagtgtcattgagaacagatttttggcttgagatacagatgtaaaattaagaagattcagctaaaagctacagtcttagacttaattgaaaatatcagtaggaaatcatgatgaagtttatatttaaaaaatacaaaattgctgactttgtccacaaaaagggtctcagagcaatgaccataaactgaagtccaatagagtcatgtgaaaaaggactcaggagctttcactgtgttcaggtttcctccattggtcaaatatgggatagtttaagaatcaaaagaataataacctgagtgaattgaaacaaaccaaatatatcttaaactaaaggctcttaatacttaaatgaaaaatcctcagcaattacctttgggagaggatattagaaaaccagctcactgttttgaaaacgtaagtgaagggaaaaagtcaagcatttattctgccccttttcgaagtacggtactttaggataaccagataattgtggggttatcctaataattgaaggaatatagtaataagtaatataagggatgtttctctttacagaatgagtgatagaataagagtattactattttgcaccgcctgatgggcaatgataaccaaaggctgttaacatcaccaaaagagagatagacacacatgatgaacctcctgatagatgcacatggaactgcctatgaagtagtctcgggggaaaaaaaaaaaactagcctgactccaatcagggttctacatttaactgtgagctttcagaaagaacatgttaaataccactatggcaatgtggtcagcaaaagacagattgcaggaaaaccttatattacaaatgacttggtttcttaaacaaatttcaaacaaaagataaagaggagtctgtagatggaaaaaaaaacctaagaaacaaattaacaccagtgaatgcaccttgtttgcccaatttgaataaagtagatcatttttaagaacatagaggccaggcgtagtggctcatgcctgtaaacctagcactttgggaggctaaggtaggaggatcgcttgagcccaggagtttgagactagcctgggcaacatagtgagacctcctctgtattaaaaaatcaaaaaattagctgggtgtggtggtgcgttcctgtagtctcagctacttgagcggctgaggcaggaggattacttgagtctgggaagtcgaggctgcagtgagccatgatcatgccactgcactccagtctgtgcaacagagtgagaacattggccagttagtgaaatgtgaataccgactgggtaataggtgatattaagaaactattattattattattattattattattattattattattattacttgagacagagtcttgttctgtcgcccaggctgaagtgccgtggcacaatcctggctcactgcaacctccacctcctgggttcaagcgattctccggtctcagcctcccgagtatctgggactacaggcatgagtcaccacgcctggctaatttttgtatttttaatagagacgggtttttgccaagttggccaggctagtcttgaactcctgacctcaggtgatcacctgcctcggccccactaagtgccaggattacaggcgtgagccaccatgcccggccaataaattattttagataccagcctgatgatggtatcatggttatgtttagaaatgagagttcttggcttatagaggtactcatttatatatgaaatagtgtaatacgtggagtttgctttcaaaataatatgtgtgtagggtagaggctgggaatggaatggattaaggcatagatgaatcagtattgaccatgacttgataattgttgaatcaacgtaataggtacataggatttattctattctcttaaataaaaagttttttaaaagaatataggttttggagtcagactgcctaggttcaaaatccagatctgtcactgactaagccttgtgctatggagttacttagcgtctctgtgtattagtgtccttgcctataaaatggaaataatataatattaactgcataatagaattgttctaggaactaaatggttataagtggaaagcgcttatgaatgttagctttgatgtgttcattatcacacatcaaagatatacgttaaagttataaatcattggctaaagatcttagtgtacttaggaatagtctagttgaattccttatttagtaacccaggagtttgaaacccacatttagcaaaatgtccagtggtagaaccagaactcaactttatgtctcttgactcctagtctttacaactgcttcacagtaaatcacttcaaagaatatccaagagtcaaaagacagaatttttacaaatttagttaaatgatataatggcttttaatagtaattcatgagtcaggcagcatctcatctaaagaacagataagcactacactgggcaggcagaacagttagtttttgtagggaaacttgagcaggaacaaagaaacagtggattggttaacattagttgcttcagattactttcattgtaagggtcaaagcagaggggactttcttatgttggctaaaactgtcccatttggggatttgacacacacactctcctgatttctcagaaggtcagataaataacttaggtttagtttggtgatatgcaactttggcacgagtgactgcattttggttcagtctgtttggtttgatctgtagagtagaagctcaatccatattagtagtctcccataaattttatttaacacaagtaagcttaagtaaccttgttctaaatagaaagactcacagttgcaaacatcttcagttttcctgtatctaaaatgtattgcagttcaaatgaagactccaagttcttgtttgtctgtttgctttgagaaggaacagacaaacttaacataagatgagtctaaatttatctggggagtggaacactaaacaaacatgttagaaaaattttgaggaaataaaggaagaatatttgttccaccatatattataacatattgcatagttataataattttatggttctggcccaggaataggcagatggatgaaaccaattagtgtcctgaaataaacccccaagagtacgtagattttagtattaaatctttcaaatctgtcattctttttgggatgactgatcttgccagatatatgtaaagctggatacttagtaagtctagtttgtttcgtagaaatattagaagaaaatacaagtgaatgttgttatagtacagaagaagggaaagcctttggagtaaaaatagtgaaatacagatgctaaaatggagagaacttataaattttaccatatgcaaacgtaaaactttgttacaatagatgccttaagttaaagacagaagaggaaacaaatattggcagcatgtatagcttactgtattagtcagggcccagttaggagccagaaactatactaggcatttgaacagagcaaatttaatataaagaattattaatggccggtcgcggtggctcatgcctgtaatcccagcactttgggaggccgaggcaggtggatcacctgaggtcaggagttcgagaccagcctggccaacatggtgaaaccctgtctctactaaaaatacaaaaattagccggacgtggtggtgcacgtctgtaatcccggctacttgagaggctgaggtacaagaatcgcttgaacctgtgaggcgaagattgcagtgagccgagatcacgccattgcactccagtctgggcaatagagcgagactccatctcaaaaaaaaaaaagaattattaactattaaaatctacttactaaaaagggcaaaataggacattaaagaatacaaaaatagtaaatatagggattagctatgactacctcttgagctgagggagagaatccaaaaatcaggaagactgttgttcagaccttgttgaagaaagtgtagctgctgccaaaggacatagctatgggccaaagctggggcacaggaaatcccctgctgggaggcctcagagctggtgtgcagaaaacacctgctggggtgctgtgggctggacagatgataagccgaaaattgcccactgggatgacatgagttggagctggtgtacaggaccctatccaatgggatgcagtgtgtcagagctggtgcacagaaagccccatgctggagtaagctagagaaacttacaggagggtgatcattattgggtctttcacaatcagcctcaccataggagcaaaaagaagagcatcctccaaactgaaaattaagcccatcactctgctttgctgtgcaacaaagcaccagctgacaaaagtccatatccactactgcaaagaaggacagatttggagctgagagccttgaaataataactctcattataccaaaagctcttatatatagataagaaaattataaacactctaattggaaaaacggcagcatatttatatacataattcacaaaagaataaatacaaaaggcttgtcattgtttgaaaggatcaagtcaaatttgctattaatagatttccctgatttcatcttgttgtacagatttatgttttctggatcttccatcactgtgaatgtatgttgtttcctaagattatacatgatttccctccttgggggaggttctgcttgactggggttctatctcctttttgtactgttgttcttcatttacctaagttatgtagctagtttagatttctcttcagggcctgctctagacagtgcaataggccaaaaaagttcttttttaaaaaaggaaagggagattggaaaggcataaataaatctgtctctactcacatacaagcatgattgtctatgtagataatccccaaactgtatttacagaggctgatacagctaatgagataatttaggatggccacaggataaaaggttaatacacataaatcaatttcattcctacatactagcagagaacaactggaaattttaaaaaatttaaagtaccacttagaatagcatcaaaagtatttgaaatacctaggtatttatctaacagagcatgaatgagatttgcttactgaaatctgtaaaacatttatgaaagaaatcagacttaaatagagagataaacctgtgttcagggaaaagaagacaatatttttaagacgtcaagttgccacaaattcaacacaatcccaatcaaaatcccagcaggctgggcagatgttaggtcaactgtaaataaagctgctgtcgttgccattgttgttgttatttcatagaactagcctgcagtggagcttgctgctttgtgatgtagggagttcctgtcattcacacttttcaaatacagatcgctaagaccctttgtcaaggatgtcatataggaaattatatcattaggtaggatgctggactagatctacttcaacccttctaattaaaaatattatgatctattatttgtaagttagcaatttacagctgtggggcatgtggaaagggagctactggaatattcagactttttcaaatgtacttatcctttccccgtcaccctgtaaaaccattgcatataatgagggatcttagtaataggagtgtgttgcatgagtgagctgtttaaggactctaatgtgacgtttattttactttgttgttgttgttcttacttatcaagctgactgaaaaggaaagttttatcaatcttttccactctttgaattctaattatagctcttaaaaaatggtataaatcttagggaagtattctttaatatttatttttagacatttttaatttctccaatatagtcaacttagtaaatagttccaaataaggaaactcagaaattatctttaaaacagttagttgtaccagcaaatcattttttaaagataattgtattcctaacatgtattttttattatatatttattttatgcttttgcaaaaatatgtgaaagcttcaaataatgagtaaaaatcctgtggattttatgatttaaaaattggttgaaatatgaatagctgcctagttctattttcattaatgtcttaatttcctttttattttaaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtagtaagtatttttcaaagaagtgtgtttatttctgtaacctttagatatttttaaatgtagtcaccgagagatcagttatcttatatatactagtttgtgtactgcaaatgaaatagaagaattcacatagaatgtaataccttcattggctgatgagaaagctgagcccagaaatactttggtagcttatgtaagatcacatagcaagtcagtggcttacctaagcctagagtctagactcttacttgaacacactggcactctgaaacacagctgccaccattttctggcagatgattagcacacatgtgtgtgcgtgtatgtgtgtccccagttgtcttcacagctctctgttcaagaagcagaaatctttccacacttctccttgaagtgtggaaagatgatccttttgaaaaacataatatgtaagaatgcaactgactatacaaaacttaaccttaaatcgtataccgatgcccagacccttcaaaataaggatgacccagtgtcggacaattgtggtagcaatagttataaagattcttttttaaaaatgcatttaaaaagtgtcaagtgtatttaagaatactcagccataattgctttttactatactttatatatagtaaatgattcttagatattacctactattatcatcaatatctaacattttagtaatagaattatccagctttagtaataaagattaatgacataccttgagatctatacatgacattcataaaaatgatcagaactatagttgttaaagacataatgtctcattacaaatttgtcatacaagtaaacattcttagaaatatattttctatttttgaaatgcatgatctcctgttgcaaaaagtaatttacaagtatttaacattaaaaagcaatctgttatagttaaaatagcctcttaaaatcaatatttggaaactagaaaatttttaaatcatatttattataccaataacagtagttaaaaattttttttgttttttaagacagggtctcgctgtgtcaccctggctggagtgcagtggtttgatcatagctcaccacagcctcaaactcctgggcttaagcgatcctcctgccaacctgagtagctggaactacaggcacgcactaccatgaccagccaattttgtattttttgtagagatggggtttcactgtgttgctcagtctggtcttcagcgcctgggctcaagtgatactcctgcctcggcctcccaaagtgctggggttacaggtgtgagccactgctcctggcccagtagtaatagttgacattcatatagtactttttcatttaaggaaagctcacatggcttcatttaatttattgtagtctaatctgttagaactattgatattatagatagtcttaggaaaaataataccttaaattcacaaattggactttaactgtggtcagttggtattgcgtgccagatctttttccaggcaaaggtgtagtttgcaaacagtgagagtatgactttccatgcgttaagttcttcatcgtgaatgacagtatgtactcttctattcagttaaattggtaccttgccaatgctttagtatgaaattgagttaacaagtacttggataatatttaataattggatcataaaaactttacttgtttttttcctctccaaaaagcatatttttgagattttgatctggtatttatcaattaaattatgtaattttatttatgcttttcttcttcagaaggaacataatcttcaagttttgggtctggtgaaatcagatgaagggttctatcagtgcattgctgaaaatgatgttggaaatgcacaagctggagcccaactgataatccttgaacatggtaagaagggctgaaatagtcagatgatagaggctgtgtgcttgatgaacaagcacccatccgtccaaataactcatgattgataacccattagtaaaggccaatatgtggcatagctaagagaaaaagaatagcagtctaaatcatttctattacataaaattacctagaagcacaattttggataatgttgaaaagaaatttttactaagaaaaggaaaactgaatattatagtcttaataaattaatttttaaaagaatttagtcatcttaatctcacaaatatatttctgtcctataaagaaaaacttcttttttttccaattctatacacttttattaatacacttacaaaaaataacattcaaacactgagaaaactaaataactttggaagcagagctcattgttttctgcttacatataagtgacaattctgggctgttggcacaaaatagtcaacattcataaaaccctgactactatatatcaaacataagttaaaatcataggcagtagtttatcaaatccacgtttcttagaaaaacttagtatttattttgcattgaaatttttagtttttccagaatacaattaatttaccttttctgattaccaccaaaaaaccaagtttattatttaaaaattcagataacaatgaaaagtataaagaaaaaaatccatcctgtatctcaaattagggaacccacactgtaatttgagcagagttttaacataaggaattaacattgatattgggattggagtaacaaaggtttgactagtaagaagtaaagagaactctagacaatataagaatggcaactatcaggagcaactacaacccctaggtctgagatagagccctcaggaagaggcccctctttttacggatgagatccagaccctgttggagagggtgtaaccatggtttactggatggcagagaagttgatgtggtgttttgctctctaaacttgctcaaaatctcctttcttgagggttggggaaagctgcttacagagaggtatctcactggaggcattctgctacaaaaccacccagtggatcaggtgtaaggggaagctgctggctataggaggctgccagggtagtacactagaaccaggaaggaaactcctttcttctgtactgtatctccattgccttctattgataaagtttaatacatatgccagctggcaaaggaaaagtatataaaggacatggctctgtttttgcagcataggcaatgaaatcagaatttggagctgagaggcagtaaattgataactggtacacacttcaaatcctaccacctgggtacactgtgtatggttttataatttcctgttttgttgcaacagcatgctgtgtatatctttctgtgtcaacagttgatctgcatcaatattgtttcttattaaataatatgtatatatatatatatacactgttttatataacagattttatattggttaacatttagattgtcacctgttttttcctattacaaacaaggatgtattgaactttttatgtgattattttcttatactaaattactagaagttgaattattggataacagttctgtgttaaattgataagggtacctgttgggtgcattattcatttgttttagcaactgaaacatttttcattttgagcatttctcaaaaatacatgaaaaagatgccactttagacatctgatcttttattcaagtcaaatacaatcaggtattggtgtgcctccaggaagaatttctctgatgattgtagtttggccagggaagctaattggcaaagatggcacctactctggcttttcactaacatggcatatatgtaggatttttgtgtgctattttttgaaaaatatacttgagagtgctgttacagaaaagcataaaatattagaactgcttttttcttcttaggtttgtatataccctcccctgtttattggaaatgattttagtagaagcatgccatttttccatcttggtgaaatgcctgagtacaattactaaataaggcactagcagaattagtgaggtagataggcttatttctttttacttgtggcagtgacttttcttagtaaacctcgtagctatttggggtatatttatttacatggaactaagcaaaggcacttcattatatttgtgtttgagattactgttacaaatctaactctaacagtagaaatggttaagtatgccaggaagttcctaaactaatcctaattgggctttcctctgaaaatatttggatagtgttaaaattgtagtcatagtgtatttgcttctctctttttgagaatagcgttttatgagctgatgaaattttttagtgacgttattgggcatgtattaaagatgcatagattataagaaggagagtaagtgtcatgttattaattgtgttttctattttgctgttttaatttgcaagataaatatttatacaggaaagctaaaagaaggaatacagtaacttactagatctgagctcttcttttttagagtttacaatataataagggatgtaagagatatataaaacttgaataccagtccagatgcataaataaagcagcatacagttcagaagagaggaattctgtctgtgtgatcagggaattttttcatgtaaggtgtcccctttgtaataggccttgaattataagatttctagatgttaattcaaaggaagacctggatcaatatggaaataaaatagaagacctgttcctgtagtaaggtagcctttaacagcagaataggatcagagtgcatgattataaataataaaaacaatgccatgtgtaatgagtatgatgataaagtcaggtttagaggaagacagagtgcaagctggttgaaggaaaattgttatgaggccattgtgagatgataaatacttacactagagaaatcggtggaaaaggatcctactaaggagattgtgttagtctgttcttgcattgctataaagaaatacgtgaggctaggtaatttataaagaaaagaggtttagttggctcccagttccacaggctgtacaggaagcatggtgctggcatctgcttggctcctggggaggcctcaggaagcttccaatcatggtggaaggcaagaggggagcaggcatctcacatggcaggaccaggatcaggagagtgaggtgggggggtgccacacacttttaaacaaccagatcttgtgagaactcactatctcaaggacagcaccaagccatgagggatcttcccccatgacccaaacacctccccaggttccacctccaacactggggattaccttttcacatgagatttgggcagggacaaatatccagactatgtcagaggtgttagtgatttatctgattgagactttatcaactgattgaacattaaacattgttatagagaagccagagatacttccaaggtttacccaagttctgggtaactaggtgtattagtccattttcacactgctgttaaagacatacctgaaacagggcaatttacaaaagagatttaatgggacttgcccttccacatggctggggaggtctcacaatcatggcagaaggcaaggaggagcgagtcacatcttatatggatggcagcaggcaaagagagagcttgtgcagggaaactcccattttccaagccatcagatctcatgagactcattcactatcacgagaacagcacaggaaagacccacccctataattcaatcatctcccactgggtgattccactgggaggtggaatgggaattgtgggagttacaattcaagataagatttgggtggggacacatccaaaccatatcactagaagaatggtgacacctttacaaaaacagaaaaagagggcagatcaaagtggaaggagatttccacttctgtttaggatataaagaggtgcataaagaaaatcccattctcaccacataaagagcttagtaatctacaacgtcacaggttctcttgagcccagcagagagctgagcatgcaaagcaaatatattagttcattttcacactgctgataaagacatacctgagactgggtaatttataaagaaaaagaggtttaatggactcacagttccacatggctggggaggcctcacaatcatggcagaaggcaaaaggcacatgttacatggtggcagacaagagagaatgggagtcaagtgaaaggggaaacccctcatgaaatcatcatgtcgtgagatttactcactaccacaagaaccgtatggggagaaccacccccatgatttaattatctaccagtaggtcccttccacaacacgtgggaattatgggagctacaattcaaggtgaggtttgggtggggacacagccaaaccataacagcaaccaaataacctaaattccaaaaaggacaaccctccccacacaaccccctcaaaggcatagatcatatgcattgtttcacttttggcagaacacaagagaaagagacggctactgtaaaagtgagtaagaggaaaactcctagagttttaactaaaaggcctttaactgcaaggccaactatggcctaatttggaatgtctgggggcctcagacagaatgggagtttacactttcttgcaaacacttttccttggggctccacagagtactcccaattaagaggaggcaaaagcaggagactacagaaagccatctctgtggtgtagggatgaaggaagtgatgatctgcagctgcagagagagaatgatgcagagaggcctttgtgcctgggagacaggacaaaggccttcccatttactcagacccttctcctttaagcctcaaaccagtgggggaggggcagaaaaccttctgatttcatacgtttctgaagggagattagaagtcaaacccctgtgctgcttagaggaggaaccctcctgtccccaggatgcaggcagagactcattgatgccggggaaagggtagaagagaaaaccctttacttctgaaagaggcgcagaaatcattttaggcctcaggattctacactgataccaaggagaggtcttttactactaggggaagagtaggaaacttctacctaagaccgatacaaatacaaggcagattttgactgccacaggaagaagagccagagggcctacctaagactgaggctggaccagaacaatggagaatcctagctgcctcaaccatgaactttctactgtttgggaaaggtcaagagcacagagggatatcctgtggtattggtatgctggagtggttgaaaactcagaggaaaggaaaaaaaaagagagagaaactctctggctcctaagcacaggacaatggtagtctcccagtagaggaatttgaaacctatagtatacttaaggtaactataacaataaaatccattccaagctcaattcctgactagattaactaaactctttcacactaatgacatgacagaaaaataagcataccatttttcaggtgtaaataatacttactgttgttcagcataccgtgttcagcattcaagcaaaaattaatagactttaataagcccatctattgagagagaaactaatcattagaactaatttcagcctttgtgacttctatgcaatagaaagatgttcttagaaaatataccattcaaatttcattctttatataccttttttaaaattaattaattaattaatttttttgagacggagtttcactcttgtcgcccaggctgtagtacagtggcgcgatctcagctcactgcagcctccgcctcccgggttcaagcaattctcctgcctcagcctcccgagtagctgggattacaggtgcgtgccaccatgcctggctaacttttgtatttttagtagagacagggtttcatatatacctttatttttaaaattacttgaggtatactcctacagactacaagatgagtcaaaccaagaactcaaaaacaacacacactcttaacatctgatccagcagttgcacttctttgtatttacctgaatgagttgaaaagttatgtccacacaaaacccctcaaatgtgtttgtagcatctttattcctaattaccaagatgtccttcagtaggtgaaagaataaataaaccgttgtacatctagacagtggaatattattcattaccaaaaagaaatgacctaccaggccaggtgccgtggcttacgcctgtactcccagcactttgggaggtggaggtgggcagatcacttgagggcaggagttcgagaccagcttggccaacttggcaaaaccccgtgtctactaaaaatacaaaaattagctgggcgtagtggtgcatgcctgtaatcccagctactcaggaggatgaagcatgtgaatcacttgaacccgggaggcgaaggttgcagtgagccaagattgcaccactgcactccagcctgggtgacagagtgagactctgtctcaaaagaaaaaaagaaagaaaagaaaaagaaaaaagaaatgagctgtcaaaccataatgcacttgaggaattataaatgcaaattaccaagtgaaagaagccaatttgaaagggctaaaaaccgtgtgattccaactacatgacattctagaaaaggcaaaactatggagttagtaaaaaaattagtggttgccagggtttgggaggagagagcgatgaataagcagaacacagatgtttatggcagtgaaaccactctgtatgatactataggggaggatacgtgtcataaatttgtccaagcccatagaatttgcaacatcaagagtgaacactaatataaactatggactttgggtgataatgatgtctcaatacaggttattcaattgtaataaatgtaccactttagtgggggatgttgataatgggggaaactatgcatgtgtagggcagaggaaattttggtaccttatgctcagttttgcaatgaacctaaaactgctctacacacttattaggatagttaaaatccaaaatactgacaacaccatcaaactctcacaaggatgtagagcaacaggaactcttattcattgttgctgggaatgcaaaatggtacagccattttcgaagatagtttggcagtttcttacaaaattaaacatttttatcataaaatttagcagttgtgctccttgatgtttacccagatgagttgaaaatttatgctaacacaaaatttacacacaaatgtttagaagaattttactcattattgccaaaacttggaagcaaccaaaatatcctttggtatctgaatggataaacaaagtgtgatacatctatacaatggaacgtcattcattgaacagagcatctaagatgggacaatatcagaggctataacataagtaaattataagtaaatgggagtctcacagggaaaacagaacaaggacagggagaaacaaatgtttgaatagataatggccaagaattttaaaaaatgaattagatcaaaccacacaaccaaaaagaagctcagacaacccccaagcaaactaaataccatgatgatgataataataataataaaaagaaaatatgcctgtacacatcatagtcaaacttctggaaaccaaacatgaaaatatcttgaaggcaattggaaatttaaaaagaagaaagacacattacatacagaggaacaaagataagaattgcagcagactttttgccagaaaaaaaaaaaaatgtgagctagaagacactgagcagtagtttttagtttaaaaaaaaataattaaggggccatggtaatcttcactgtattgttccaattttagtattagtgtatgtgctgcccaagtgagcacagagcaactttttaagtccttaaaaaaaaaggcaaccaaaaaaaaggcaaccaaaactatacccagcaaaaatatctttcaaaaattaaagtgaaataaagaccttttcagaacagaaactgagaatttgttgctgacatacccatgctacaagaaatgtgaaaggagaaaaacaaagtgggctagagtgtttttaaagtaaatataaaaatatatttttaagattaattgctttaagagataattgactgtctagacaggcccacaaaatttttttcttctttttttttcactctaaatagtttatttccaccttcacaaactcatgcacctctggccattatgcaaggcaccatgaattaaatagtcatatcagtatatatttgtcttacatgattcaagataaagtgaattttaaaagcaaatgggtgccaatgatggggaggtgaggggaatagggcaggcagcaatagggtaacacgcaacaaaattttctgtaaagggctagatagtaaatattttaggcttaatgggtcagtctctgtcacagctacttaactctaccattctagcgcaaaagccaccatatagatcaaacaaccttggctgctccggtgaaactttgtttacaaaaacaagtagcaggtcctaatatgcttactctggtctaacacagaaatagttgataacatgaaatttagaagtgtgacagaatggtatatgtagtgtagtccgatgtgtagggtagaattgaaaataaactattgtaagattattactgcacacaacaatactgtgtgtcgaagatgctcagatactttcaatattatttttaaacaagactcatgaagataacaactattacaaaatatttcctttttcaataattcactccattatttttctagttaagctcagatagtgatcacagagatatgttagtaaactatctgtagtttgtagttctccctttaacagttcctttttggagtgactagggcacatttcctcctcattattcatacaccaagtctgactttcttcacttatccttatattcttcattctcctgctccctgtttgcctttttttcctcccactccttccccctttttatttaaaaaattttaagtgaaacagacatccactgatgagaaataacttagaatcacaaactatcacggctgaaagatacgtatcatgtagtacagtggttggcaaactttctgttaagggccaaagaatagatacttcaggctttacctgacatttggtctctgtttacattgctcacctctgctattataagtttgaaaaccaccacagacagaatacagacaatctgtaacaaatatgtgtagctgtgttcctgtaaaactttatatacaaaagcaggaagtacactggatttggcctgtgggcacagtttgcgaatctcaatctagtccatcttcccttgaatatccttacatcagtgtttcccaaattgtgccctttaagatgtattaatgggtctactaaaaagcaaataaaatgaacaaaaaggatgctccacagtccaacagattttgggactgctatatataaacattatattctacgttggaaattcgcaatgctaatgaacacaaatggaaagaggctcaaggtgggccagttttcatcatttctccttcaggctgcccaagcgtctgcctttctcctaccaaatccagacatatcagtgaagtctgtcagaatttgctatatttacttcttgcaagataacccaattctcctgtgaaaggaattgtttgtagactcttaacttctgtctgtcatgtttttggcagaaagtcatcaatgttatatctggtggcttttctaaattttaccactgattaaaaggtgagtttagtatttaaaaaaaaaaagactttactaattatataaaagtaatacatgattattttagaacactgagaaaaatatcactgcccaaagataaccagtgttaacattttggtatggaaatgtctaaatgtgtatatacactttttaaaattaaattcagattatttggtatatattgttttgtatcttgtttttctacttgttgttatatcctgagatcttcctgatatcattacaggggttcaaaggcatggtttttaatggccaaaaaacttttccatcataaggttgtactataattattttaactacttcctctattttgggacatttaagtcatttcctattcttctgttctttatccctgtctgtttttcctttttcaattactaatgctcatattagtagtctttgtccaaatctctgattctttccttaggaaaaattcctaaaagaacaattaatggttcgagtcagtaatttatgtaattgtcaaaatggttttagtaaatgatgtaacaatttacatttttactaagagtgaagaaaggatacaaacctaatcacacattagccaactattaaaaagtaatgttcatttaaaaatacaaaatttaggctgggtgcagtggctcacccctgtaatcccagctgggagctgaggcaagaggattacttgagcccaaaacttcaagacttgcctgggcaacatagtgagaccccatcctcacaaaaagttaaaaaaaaaaaattggccaagtgtggtggcacacacctttggtcccaggtactaaagaggctgagatgggaggattgcttgagcctgagaggtcgaggcttcaatgagctgtgattgcaccactgcactctagcctgggcaacagagcaagaccaccaccctacccatgcaaaaataaacttcattattaggcaaaaatgacatcttacccattgaattttatatctttgattgtgaagtggaatatttgtcatatgtttagaaatacagttactccttggtatacatgggagattggttccaggacccacacatatatgcccagatctgtgcatattcaagtactgtagtcacctctgtaagacctgagtacatgaaaactaggctgcctgtatagtcgggttttgcatcctgcaaataccgtattttttgttgcgtttgtttgaaaataaaaatcaccatgtaagtggaaccatgcagttcaaaaccggcttgttgaaggatccactgtagtctgtctttgctcttctgtgagttgtattcttctgttagttattgaaaaacgaaatcaatctcttgtgatggtgcttatcttcaaaaccttctttaaaaataatgttgaaagtatttgactgtgcatctttgatagttttatttctgtagggagagttttctgattcccacctgaagtgtgtggctatatatactggccataggccagctggctagtgctgggctgcaagaagctgcgttggagcgtccacagtaggcctgtggtatacttaacatgactattaggttaattatcagctttaaacattaaatgaaacttaataattatagttaaaatatataaaacatttttgcatatcactggaaaacagaatttctgagcaaattgtgaagtagaatttgacttttgttcctagcatgctttcttaatcaaaacatttaaaatacaacttttaatatttaacttcacttttatgcattttcggtaacagcagctcttgattttagaagatcttgtatcttttaaaaatatttaactgaacataaaacaggattatttttatttgctgccatttcagattaacattgcctgtcattttatgctaaaatcctttgttttttataattatctattaaattacattttcaaaaaaaagcattggcaggtacattgttattattatttaaattattactggtcaattaagagtagtaggaattaaggtaaaatgtctgtatcttttgtccattaactttttattggcctttcttcctgtcagttgaatttaaaaatagattgcgaaattatcatgtgagactggaatgtgaaaacatagaaatacactttctttttctgtcctttcataccacgtctgataattgccaaattttagttctagtaaaggaagaaggattcatgaaaagggagtaacatcaacttgtttttagtaaaggaaacttacactttaccagctccttaaatgactgctgggatgttatggccatagtagataagaatacacactgagcatcccccaccctttttttgacagaaatgtttgtaaaaaattccaaatagtatctgaggttagcattgaataatagaagttctggaataagtgactaatggcctggcatgattaaaagttggctagatagcaggaaattgttactcattagtggaatattttaatttcaaagcactaggatgtacagtagttggtgttgatgttaattaaaggataagttctaatcagttattttgcttttttgtaacggtaattataactttagggagagttttattcaaggtaactggtgtaatttgacttcttaatcatgaaattcatgtctaggaactttctaaagactgaatatgtatctgctgtcactgcttgggttctagttcatgtctgctgttaatgactggattacatattgtaattctgtgattttttattttctataaaataaaggaattaaatttaatgatctcttaggtcccatatcactccaaatactctgttaaatgcagttgttttacaaacatatgcatttaatgtaaaatgtgcttcagaacgctttttccgtataggtattgaaatagatatgttgtttgcagacagattgaggcatttccagttaatgattttatgtaacctgtcataactcgtataatgaaacaaaccttgtgctaaaagtctgacatattggattaatgtcccagtcccactgtggatgaggtgattaacctctctatgcatcagttttgttacctataactctaaacagtcatctctgcacagcacacctttgaggggcaaatggaataatatatgtaaagcattttgtaaattgttaagtactctgtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatctttaggataatagtaactttaggataatagtaactttaggataatagtaattggaaagaacatagaaagacagagtatcgatgagaattcaatagtcagcattaaaggagattaaaagtgaagataaaagcttaactttatgaagcaaagtttgaaggttttttcaaaatagacaacagaaatccatataatattcagttagatcatttaaatttgcaaaattagaaaatcttctttatatgaccagattgtaaggcatctgtaatgatctggttaaaactaaacttgcactaaaatattttaaagcaaatgtaacacatgttcattgtcaagaataagaatacataattgactgaaataaaagtaaatttactttttaacccttctcttaatattactttctagagataaccctcattaacaaacattctgtgtatttgtgcattcagaaataaattgttgagcaaaattctatatggcatatacaattgtgtattcattgtgctaagtggtgaggatgaaacagctaacaagcagacatgattctctgccttcatagtgcttattgtctgttagtagagacagacaataagcaagtaaatgaataattataccttttattgtctacttaaataaaagtactactctgataaagaattattggggtagagtggaagttattttaaataggttagacacagagggcctttctgaagtgatatttaagttgagacctgagggttagaaggagcctatgcgtgtgtgttttacacttacacatacatatacacatattcatgtataaactttttatttgcagaagtgaaatcatatttttctgtgacttttgaaaacagtgtcttatggacatggtagtccttatattacaggtttatctttttcattttttttaaactgatctatacttctcagactagagtatgaggaaacatagttttgagttcttgaaacattgtaaatttttttgagatgcagtttaagaataatttaaaattcacacaccctttcatcaaacaatcctatttataataatttatcttacagatatagttactaagtatttaaagattcatatgttagactagcataaatctctaagtaacctaattgatccaaccaataagggactagttaaatacagaatagagtggaatactaggaagctgttaataagatgtatggaaaaatatccaatttatattattaataaaaacaagttgcagaaaagtatgtatactctgatttcatttatggaaaagagaaggaaagatataaatgtctgtgtccttgtatgtgtaagaaagttttgcaagtctacacagaaatctattaatgatggttatagctgaggaatgggattggaaaaacctgaagatgaggaggaaggcaaaaataatacatttgaaatttttggaaagccaaataaaaacatcaattagaaattaaacttggaatatttaaatctatacctggtgatttctaccttgttcaaggtagttataaactttttgagtttttatttcttgaaacaaaatgctataggagaaaaaatagtttaataaaagtatttggcaacagtctgcaaatgttagttaatatagcatttttttcctagaagatgaatcatgtcatataaatgctgaggtggttaagtataatttattaaaattttaaaaactaatttgttttgttaaccaagtacttaatatgttgagtacatgtgctgtgtaaatagagattcacagttatctagcagataccctattatataggctattaggggagataatgtaaaattatagagtctagctagaatagaccttagagagctgagtatttaatttagctgagctggaaactcagttaagtgacttgccataaaataactagttggcatcagagtcaggactgatatcttggttttcaatttcaaaattcactgtatcactttagcaagtttaatgttttcaagacaaaaatttatgttcttttttccgcttatgttctcttaatttcaagttcagtcttttaagtcagtataaataagtgttattacttactgacaaggttggtcagatgtatcattttgctaggatgaccatacatctagtgtgcctaagacaatcccccagcataattaccaaaaagtgtctcctttcacttttagtagtatctggttgtggacaacatattccatggtcaccccaattgttgctaatttattgaatctgaaagattctacacagtgccagggtaaagattttggattatgaatctaaataattataatgcaagctgtgctgaatgccaaagcgctactctaattctaaactggaagaaataatttctgctaggtttgacaggcaagggaggctgattgaagaacgtggcatgtgagccgagcctagaaggatggatgggattatagattagtcaggttacatgaagatgggaagaggtgtatatgcaagaaggctcaaagtgcatttggagaatagccagcatctcggtttaccagtgttgagagaagtatgagtacaggaatatacatctgggaaggtgtgcagagaccagattatttaataccaagtcaaagggttggaatttgttgagcagttggaggactccagcagttttcagttatgtagcactttaagaggattaatttattagagatgtgttgagtggctttagagaggaaaatatggaatctgtcctaccatttagaaggattttgtaccaaatcagatgtgatgtttaaggccctggactagtttatggcaatggagagagagaggctttctttttattccctaatggctttgtattagttcatttgcattgctataaaagaatacctaaggatgggtaatttataaagaaaagagatttatttggctcctggttctgcaggctgtacaagaagcatggcaccatcatctgcttccaatgagggcttcaggaagatttttaatcatggcagaaggcaaaatgggagcaggcatgtcacatggtgagagaggaggaggttccaggctcttttaaacaaccagttctcaaggaaactaaccgagtaagaacctactcagtgcaagaaagacatcaggccattcctgagggttctgtccccatgacacaaacactctccactaggctgaccctccaaattggagatcaaatttcaacatgaggtttggaggggacaaacatccagacgatatcaggcttatacatggtacatatttattacatgttggatagatgtttctacaaaagaagatggcacaagatttatgatttattggatacttaggataagagagaagaaaacattagagttttacactaattaaaagtagagggattttctgtataagtgtaaggatatgatctttgttctacttagcttaaggaggtttgtctccattaattttgagttatgctataatgaatgctgtttttagatagctttgaagaggtagacatataattaaagtatgaataatttgtttgatgttgaacatcaatttcatctttgccaaaggtcatggactttaagaccagaatttctgaggtccacataataatttaatgactcaatgataatttttggtgttaaataaaagtcctgcagatgacctttctggacacaaagttgaatttagaattatcaaagagcaagcttgaatttgaatttgatgctattattttgttataaagaaagaatctattatgcagtgctaaaacaccagaaggaagatagtatgtctgaatatcttttaattggtagttatatttaaaagatgctaaattatacaataatgtcatagttggcaaaatatcatttgagtctgaaagatatcactgacaatctggctgcttatagactagctttcatatagtttccatgctgcgtctgtgtgtttttcattttaggttatagtgttgttggcaatgagaatatctcccaattgatgcatgcttaagagactaccagaaataaaaagtataatataatttgatatgcatttagagaaatgtttttctttagtattaacattttaaatgttactactgcctcataactgctgtaatagtgttttaatattttagctgtatgagtatttctcataaaaacctttatttaccaccagaattattgcctgagtttccccttatatagcatgtatctgaacattgtagaccccaaatgataaaataaattaagagactttttggctagattctggtttggtgatgattttttcctaattttagagttcctcttcattttacactcttttacaaatttgagtagttgtagtttattatagaatagttttgttaaaaatctcaattagggactacttttcaaaataatctcaggaaataaaaactgcttgaatttggacttctgcatcttaaaaaatgctaatactatttctctgtcaactacatcctagaaaattggtttatgattagatgtcatgtaaatcactaagctcattgaaagtcagtttttcttttttattggactgaatgggtaatgagcagaaatacctttctgctttttgtcttcctcctttcctctgggatgtgggaatcacattgaggagacagcatttggtttaggatgaaaggagagaaggctatcttttttctgggcccactgctgtggtaggtgcgtcattaacatctgtcacaccttttttaatgagtgcttttgatgtcaggaaaaagtcagatgacttccttaaaattaaaacatctctcttgcacgcaagaatgggaggagtattttgtgttcattttattttataacttcctccaattgtttatataagtcatttgttgaaatcagcagttcactgcaagggctgcttatcagaacctacacatatttaaaactccccagtagtgtgttcctatcagattagtacttctctgcctttgagacttggttccttagaggagaaactccagtgtctgtgagattattcacatgcactttattcccttgccagtgaaattgtttgaatactcaaaacatgtagccttggctatttttgtgagtttatgttcacattgcattttggccctaatgagtctcctagctattcatcaaccatgctcatggacatttcaggtattagagtagctttgaataatttcattttgaagtgtgttattctctcaccaccagggagactacaaaccaaattcagaagcaccaacttcagttaagctgagactgctggcaaatcctattaggtttccctagtctacttcctctcccttctctgtatgtcaatatttgaaaccttcttgcctctcaagcctataattctcttacttcggcagatgatcccacatttcccattcattggaatttaagatctttttacgatctcatgcgtggtcagtttttttggtgacagttctatgggtgttaagtttgctgcatattatagtttgtaaatatctattggattaaacttaattgtgttcttaaaattcattaaacgcttacctaatttttgtctaccttatctgtcagtttctaagaaaatatgtttctaagaggccaggcaacggtggctcacacctgtaatcccagcactttgggaggccaaagtgggcagatcgcttgagctcgggagtttgagaccagcctgggcagtatgttgaaacctcatctctataaaaatacaaaaattagccgggtgtggtagcacgttcctgtagtcccagctgctggggaggctgaggcaggggaatcacttgaacctgggaggtggagtttgcagtgagctgagattgtgccactgcattccagcctgggtgacagagcgagactccatctcaaaaagaaaaaaatatacttctaagaaagtatgattggagatttgttcaatgttttatttatattattgctttatatattcagaagctatgttgttaatgcattaggaattatgacttaccttcctggtcaattactccatttcatcaaatctaaggtaccatgcattatgagatacaacctgattgcagagatgttaaaatatggaaaaggatcaagaaaacatggtatttgttttatcagcaggaaacatttgtgttgtcctagttaattcttgttgctttcaactttgttttgtctgatactgacattattatacctacctttttttttttttttttgagacagaatctcattctgtcacccaggctggagtgcagtggcgcaatttcggctcactgcagcctcttcctcctgtgttcaagatattctcctgcctcagcctcccaagtagctaggattacaggcacccactaccatgcctggctaatttttgtatttttagtagacacagggttttacaatgttggtcaggctggtctcgaactcctgacctcaagtgacccacctgcctcagcctccctaagtactgggattacaggtgtgaacccccatgcctgtccatgcttttataatagcattgactgaaatatattttctattctttcattttcaaacttttggtgttcttttgttttagggttatcaactgtagaccactttatacttactgtccttaggagttctgccatcttgattttttctttctatttatcaaatggctgcctttaaaaattcaacgtatttagccatttttttttctagcagcactcaggattcatcatgataccttttccctcaccaaacaattaaaaagaacttcatcctttcactgccctgtttctcatatactgtacattgtcctaaactatattctctgggctataatttctactttcttggattcatcgttctttatttcacttgattatattttatgataaatttctcagagtatgtgagaagtaaatattcaaaactttgtatgtctgaaaatatattatttgcccttatatacagtttcatcatcttttagcctaatgttaggaattcagtttctcattcatttcttgattttagatgacttagtttattctctgaaagcttttggtttttttttttatttgaatttaaagaataaaaccgccagtttcatattgtccagattgagtggtttctttaaagacttgtatctgtttaggtccagaaaaatcttatgatgtatctgtttgattattgttcttgctacttattctgttagctcctcttagatttttgcttttcatgccatctgctgctcttaagtgttgtatcctgggaaagtccttagaattactttctagtccactaatttcctcttttttctttttgagttcaatgtgcttttctgtctatattgttaagaaactttatcttaggattatattagatttatagaaaaattatgaagataatacagatagttctcatatatcctacaccattttcccctatatttaacatcttaatatgataaatttgtcacaaataaccaacattgatacattttttacttacaaaagttcaaactttattcagatactgttagcttttctttttctgttccaggatcctatctaggatgccattattacatttagtcattgtgtttcattagattcttcttggctgtgacagtttctcagacttatccttgtttttgatcaacttatcagttttgaggagcattggtgaggtattttgtagaatattgctcaattagaatttgcctgatattttcttaagagtagactgggatatgggtttttgagaggaagaccacagagataaaatactgttctcatcacatcacattgagggcacatgctctcaacgtgacttatcactatagatgccatccctgatcacatagctaaggtagtgtttatcagatttctccaccataaagttacttttttttatcctttccatactctatactttggaaaaaagtcattatacactgtctacatttaaggattggagagttatgctctacctccttgtgggctaagtatttacatagactattttgtattctacacagaattgtccatccttccccatttactcatttattcaatcatttgctaatattttcttaaggattgttacaacatagatgtctgagttttctggtaatgtctttgtctggttttggtattaggataatgttggctttcttggtatatttgtgctgctataacaaaataccttagactgggtgatttataaaggacggaaatttatttctcacagttctggaggttgggagtctaagatcaaggtgccaacaggtttggtgtctggtaagagcctgtttaccacactctgtaagagtctaagtccttgtttccaagatggtgccttattgctccaccctatattggggaggaacactgtgtcttccgtggcaaaagggggaccttcaacctcaaaaccttttataggggtgctaatctgatgtatgagacagagccctcatgacctaatcacctcccaaaggccacacctcttaatactgctacactgaggattaagtttcagcatgaattttggagggaacactgtcattcagatcatagcactggctttatagaatgaggaaatgttccctctgtttctgttttctcgaaaagattgtagagcttggtattatttatccttttacggtttggtagaattcaccagtgaaactatctaggcctagtgcattcttttttttgaagatctttaattattgattaagtttgtttaatagacatagggctattcaggtattcaggttatctgtttatccttgtatgaatttttgtaatttgtgtcttttaagaaattggttggcccagagtggtcgcttacacctataatcacagcactttgggaggccgaggtgggcagatcacctgagcttaggagtttaagaccagcctgggcaacatagcaaactcctgtctctaccaaaaataaaaagaaattaagagagagagggagagggggagggggagagggagaaggagcaggaaagggaaggggaaaggaaagggaaaagggaaagggagtctctagagagagagagagagaggactgaaagggaagggaaatgggaaagggagtctctagagagagagagtggaatgaaagggaagggaaaagggaaagggagtctttttcatctaagcgggcatagagttgtttatagtattcccttatcttttttttttttttttttttttgagacagggtctcactctgtcacccaggctggagggactgaagtgcagtgtcatgatcggggctcacggcagcctcgacttcctgggctcaggtgatcctcctgcctcagcccctcaagtagctgggtccacaggtgtgtgccaccatgcccggctaatttttgtatttttggtagagacagtttcgccatgttgcccaggctggtctcaaactcctgagctcaagtgatctgctggtcttggcctcccaaaattttgggtttataggcatgaaccagcgggcctggccttcctttatccttttaatgcccatgaaatgagtagtgttagcccctctttcatatctgatattagtaatttgtggcttctctttctttttcccttggtgcctggctacaggtttaacagtctgttgatctttataaataactaacttttaatttcattttattttctctatttttctgttttcaatttcatttatttctgctctaatttttattattccccttcttctgcttgctttaggcttaattttctcttctttctctagtttcccaaggtataatctaagtttcacttattttcattcagttcaaaagattttctgtttttacatctagctccctctttggcccatgagttatttagatatatttatttccaaatatttggagttttccagctatatttttgttacttatttctaatttaacgctactgtctgaaaacatactttgtatgatttctgtttatttaaatgcgttaaagtatattttatgtcccagatgttgtctatcttggtgaatttccatgcaagcttaagaataatgtgcgttttgtcattgttggatggaatatgctataaatgtctattagatcaattgatatagatgactgttcagatcatctatatacttagtaattttttttccttcttgatttatcaattactgacagaagggtatttaaactctccagttattacagtgaattttgcctatcctcttgcagttctgtcagttttgccttatatattctggcactcttttgttgggtgcatacatgtttaggattgttatgtcttcttggaaaattgacagctttatcattatgtaataccttcctttttctctgataatcttccttgttctgaagtctgctttgtctagtattaatatagctaattaatatatcaatataacaatgtaataaaggtattccatctttcttttgattaattatagcaagctatatcattctttttttttttttttttttttttgagacggagttttgctcttgttgctgcgcagcctggagtgcaatggtgcaatctcagctcaccacaacctccaactcctgggttcaagcgattctcctgcctcagcctcccgagtagctgggattacaggcatgcgccaccacacctggctatttttgtgtttttagtagagacagggtttctccatgttggtcaggctggtctcgaactcctgacctcaggtgatccacctgcctcagcctcccaaattgctgggattacaggcatgagccactgtgcctggcctccctttactttttttgtaacttttagtcatgtggctttttaatgaaagggtatttaaactataatcactaatacatgaagatcttcaaaaaattatataatagagatcctcctattcagaattttgaagtccttgttttaatctgtaacaaagagctgttttgaactcagctgagcctccttggatggggcataagaggagcatctgttatctgctttcaatccattgcccctttgtccctttacaagttaccttacccagaattgcctgtgctcatgattctttcgttctagctatctttgttttctacctcctcctctctgacttactttcttctcctgctaatattttcccccattttaaaaaattacagtaaaatgtacatagccctaaaattaactatcttaactattgtgtgtatttccttggcattaagtgcattcattctgttgtgcagctatcactgctatccatctcaagaactcttcatcttgcaaaactgaaactctgtgcccattcaacaaagactccacatccttccctcttcccttttaccttctatttctatgatcaggactattctagccttatataagtagaaatcatacagtatttatctgtttgtgactggcttatttcacttaccataatatcctcaaggtacatccatattgtaacatatgttagcatttccttcctttttaattctgaataatattttgttacatctatataccacattttgattatctgttcatccatcattagacatttggattgtttccacatttcagatattctgaatatggatgtacaaagatctctttgagaccctgctttcaattctctagtgtatactcagagtggaattgctggatcatatgataattctattgttacttttgagaggaacttttatactgttttcacagtggctgtaccattttacatgcccaccactgatgcagaagagttccaggttttcagtatcatcaccaaaacttattactttcatttttcggggtgttttttatagtggctatcctagtgggtgtaaagtaattatccctttacttttactctgaatctttatatttaaagtgaattttcttgtagacagcacatagtttgtcttgttttttaatttactctgataatccctgtcacttaataggtatatttaggccagttacatttaaagtgattgttgctgtaaccagattaatatctaccatgtttccaactgttttctttctgttcattgcattggttattggtttcttttctccctctttttctgccttcgtcagttttgagtactttatataatcttatctcctctctcaaaattttgattatacttattttaaaaatttttagtggttgccctcagttttacagtatacgtttttaactaacctaggttcttaagacaacactatactgcttcatttgtactataggtattttataagagtattcccaattcttccctcccatcccttgtaatagtgctgtcatttatttcacttacccatatgctgtagctacccagtatattgttactactattgctttaaacaaatcattaccttttaggtcaactaagaataagaaaaataaaagattttattttacctttgctttttccttctccagcactctttctttctttgtaaatccaagtttctgacctatatcattttccttctgcttgaagaacttcttttaacatttcttgcagggcaaattatctgctgattgattctccttatttttgtttgtctgagaaagtttttatttctcattaacctttgaagtgcaattttgctggatatagaatgtaaggttggtgggtttttttttcagcactttgaatatttcactacacttaacatggcttttgacatgctctccactgtaattcttatcattattcctctggaggtagggtggttttttttattctgccgtctttcaagattttcgctttgtctttggttttctgcagtttgggtatgatgtgcttaggtgtagatttttaaaatatttattgtgcttggtatcctctcagcttcttggatctgtggttaggtgtttgtcattaattttggaaaattctcgctttattctctcttctctgatattccaattagatgtacattccactttttgataatgccccatgattttggatattctgtttttttcattcttttttctctttgcattttagtgtaggaagtttctactggctgtcctcaattgacccattctttccacacccacgttgaatctactgatgagcccatcaaaggcatgcttcattttttctttgtagaattccttttgattctttttttacagttctgtctctgtgcttactagtctcttcttgcatgttccctacttattttcattacagcccttagcattctagtcatagttatttgaaataccctggtgataattccaacatctttgtctttttctgatggttgttttgtttcttcagactggggtttttcttgtttggggcatgaaaatattataatttcttgttgaaagcttggtgtcttgtatgcagtaataagaactgagataaataggcctttagtgtgaggatttatgttaatccagctagaagttgggttgtgtgtttaatgtttgttgtagctataggttatcagagacttgaagcttctttagcgtacttgattttttgtctctactcttgacttcggaacttccctaagtattactcctcagagggagcctttttcttgcagttctttcagctaatagttgtttccgctattattcttgagcactgtttgtataatgttaagatgtgagggagaaggacatgctatgatctttgattaagtctcaggttttcagggggcttgtcttatggttgtgaccttcacaagtgtttctccagtagtacagctttcttccccctgttccctattccctttcccatctgtagtgttcccaatctatttcctgaagcccctgtcctctcttgactatgggttgtcgtattctcttctaacccccacttaggtcaaacaggaaagctgaagaaaattggaggaacaaggaatttctttcctctagctgggataagctttcacaattaattctctggaacaggttctgggcatgtttcatgatggttactcttcctctccccctgccagagacaggagggaatcttttggaatcctcgtgatgacaacctggtaaaattcctggagggaatgtccacagaaatgtagtcacccctaagactgtggcccccaggattttttcattctcacaatagtccacactcaacctctagcaatttgtaagattaccttttaagtgttcctaccagtttatgtctcccatggcttctgcttcatgtaagcaaatcttggttgctgtatgtctctgaatgcacctgtctctacagtttggggtggggatttgccctgcaatctcatttctctagtgagtccaggaaagtcattcattttcaattttccagctttttcttgtaagaatgaaaatgatgactttcaagctatttacatgccaccattgaaactggacatctctcctggctatatttttaattttcaacatctgtaattttttttttgtttttttttgagtcagagccttactctgtagcccaagctggagtgcagtggtgcgatctcggctcactgcaacccctgcctcccaggctcaagtgattctcatgcctcagcctcttgagtagctgggctacaggcatgtgccactacgtccagctaattttttgtattttagtagagatgaggtttcaccatgttgcccagggtggtcttgaactcctgagctcaagcaatctgcccaccccagcctcccaaagtgctgggattacaggcatgagccaccacacctggcctgtaaacttttttttataacagcttattcttgttttatggtattctaatattgatatctcttgaagttttctcctgtttccttatttgctgtttcctttattatttctcttgttgaattttatgcctctctttcattgtgttaattgttaattctagattgtttagctttctatacatatttgcctttgattatccctatattaggttgttgataggttgttgacctatcacaagtttattcataaaagtttgtcataagcactctttttggggaaggaggtttaaggttttgtcccaagaaaaaaagctagggtagcgtgtggctcaataggagcagaagcagcagtatttctggctcagactatccaaaaatagtttgtttttgttgttgttgttgttttgttttgtttttttaattactcatgtattttctcatgtcctttactctatggaatatctctggtcttgcttatctgctcatttgaaaacttttttcctctgccagatttagctgtagattttctctatttttttgttttcaccaaaccactttctatcgtttaagaattcttcaacattttaattttaagaatggcattttcttttttctttttcgtgtgtgtgtgtatgtgtgtgtgtgcgtgtgtgtgtgtgtgtgtttagagagacagggtttcactttgttgcccagactggagtgtggtgaagtgatcatagctcattgcagctttgaactcctgggctcaagcaacaatccccccatctcagcttcctgagcaggtgggactacaggtgcacaccaccacacccagtgacatcccttgttatacaagtagttgtttctgtaattttaagagattttggttggaaaggaaggtagacaagtatggctcaatccagcttgatccaatcacattcactttcaattaatgaatagatttgttactattagtagtggtaagttaatattaattgagcatttagtttatgccaggaaacatgataaatcctttaactatattttaatcattacttaaacacagtaaagtagatattgttactatttgtatatatgtttaagaaaatggaaacttaaaaacattaaataatctacacagcaccacacagctaatatatctgttggagctaggatatgaacccaaattctatcccagcaaactcaattaacctcagttcctcactcacctgaaacttcctccctcaagttgatttgctaataagatgcctcccttctaccaggccaaatcctgtgtatcattcaaggcccagctttaaatgccacctcagcagcagtgctctgggcaatattccagcagaaagaaaactcttaacttttaatttaactttacatttatttgacctcttgtctagcactttctactttatatgtaatacagtcatttgatgcatagtttcgtccctactgcacaatgagatcactaggaaaagtgtcaatgtccttgtgtcacttatttttacaattcccagcattccccagcatgtaccattttaataaatattattaataagtaattatatttattcagtttaacttctttaatttataaatgcatccttattggctcattataaatatttgcatggattttatttaaatatgattaaaggatcttgagcatatttgttttaaacctgtctttgggattaatatttatgaatatccaggaaatggcaaatagttttagaactaattagatagaggcttctcattatacttacgtcaataaagatatctgaatatgtatgaaaatttcaaggagattcaggatatttgggagccatttgcatactaactaaacattttgatttttccttctggaagttaaataaaatggattacaatatggaaggtgattcccaaattaaaagtaggcatcaaataaatcattgcttttgtcacataaaccttgaaggaaaatagcatatctgtcaagtcttaaaattcatgtcagaatttcacaaagcaattgattataagctatctttcttttaaatagtacgtagcaaagaagtttgtgccatttcaaataagtgacatgtcagacatggagtccctgagatttattagcaagaccattttgttctgtttcagaaaattacagaattttggaattacaaattttacctgtacagtggttatctttacagtaatccttaccattttctagtgatagggtattctttctcacaagacatcccattctagtgtttagtagaactttattttttttaaaaactgttccttattttaaactaaaatctgcctgttttctaaagcttcttttttacctatactttgaacttacagaatctataaaaatcttaagattggctaggtgtgatgactcatgcctgtaatcccagcactttgggaggcaggggcacatggatcacttgagcccaggagttcgagaccaacctgggcaatatggtgaaatgccgtctctacaaaaaacacaaaaattagtgggacatcgtggcacgcgcctgtagtcccagctgctcaggaggctgaggtgggaggatcacccgagcccaggaggtcaaggctgcagtgagctgtgattgcaccactgcactccagcctgggtgaaagagtgagaccctgtctcaaaattaaaataaaataaaataaaaataaaaacaaaaaaccttaagattttcatgctaactcccatgacagcagttgtcaagcataatgggatagggcatagggagtggggatatagttctttctctgagtctcctgagagcagatgtttataaactagattgtgacaggataagtggatgctaattctgaatcatcaccaatgtgtagtattattcctctgctttagttttcttttattcattatcattatattttaaatttggaaaaagttatgaattgtattagcttgggaagggaagaataaatatgtcttttcttatacttctcatttatgagcttcatgaaatatgactaatctgttgagagacaccattgggaacaacctgtgtacagcctgaactcattgtatctgccatgtatttttcagtggctcctttacatgacagattactctcaggagcaaataatatgcagctcttctcacattttgttagtgtttttatttttaataaagtgctatgattaatagcctagtgttattgttgtttccccattgagtgtaaatgcttcatttgaatgtctttaatctgaaggaacagttgttttattggactcttgttatttttctgtgcttctcaaggttttttgattgctttctttgagctctttgcaatggaggaaatgaactctatcagaatcatggagtaggactccgtagagaaattttgaggatgaatactgagatacttgaacattcatacatacatttttatgataatttcagaatggtagacacaccattagcaattctgattgactctccagtggcaattataaaagtagcttggccgggcacggtggctcacgcctgtaattccagcactttgggaggccgaggcaggtggatcatctgaggtcaggagttcaagaccagcctggccaacatggtgaaatcctgtttctactaaaaaacaaacaaaaaaaagcacaaaaattagctgggcgtgggtggcaggcgcctcccagctactcaggaggctgaggcaggaaaatcacatgaacccaggaggcggaggttgcagggagccgagatcgcaccattgcactccagcctgggcaacaagagcgaaactctgtctaaaaaaacgaaaaaaagtagcctatgtctggcctactggtattgtgatgacattgccatatagatcctatctgaagtgccatgtgctttcaataagtctttctgttgttgttgttgtttgcaaatcagagttaaagtataagacaagacaagaggtggacacaaaaggactattgaaaagttgagaaattgtgaactgagcttttacaagaatatggtgcccacttaccaagaggacagctcttcttgttatttttgcccttgaagtggtgataccctttagcctagtcatttctgcatttactcccaggagcctggctgtgattagaagtgtttcctgtagccatagaccaattttccttttgttcaagaatccagaaggcaagttgggcctcattggcaccaaccatcaaggacttcattagccctaaccaggggccaactaaattgtcaaattggaaatgaaggactttacatgaattcaaagccactgataagagagcttgaaggcttatcttgtgaaactgagtgttgaatgcataacttttatttgagaaagcaaataacttgggtggaacttctacaaattagagcaaaataatttaggatttatttggaggtttaatagcttgttaggtgtagccttgaatatgtagcataacatatgcatttatattatatacttagaaacattctggtctttttggttaataagagtattacttttactggctcttagattgtttcagaggaattagagctgtctagttttgtataatcaagtctttattttcatgtaaactaagtaagttctgtttagaaagtcagccccagaaggtttatttacgcactatataagctcatgttttaagattctccatatccccaaaattaacatttttgtttgtaagtgttctgttagtttttagtcattgaagaagcatttattgaatgtatagtaatattactttctacaaagaaaacgaatgtcataacataaaaatacataaacattttttacaatgaccagagcttagaaatactttaaatacagcattttttaaaattacagtggtacttctttgaaagaggttgtctgataattattgtaatatcttaaaagcacttggaccttacttctggccatgaccgaataactagtactggactaggcctcttgctgtaaacagctagaaaattagacaaaatatatggaatacatgtttgtagacatttgaaaacatgcagaaccatgatccctaagactaaggaaaacaaatgggatgagccccataattgccctcccagctttccgcttggagccacttttctgtagcataagatgccccatttatgaacaggcagaagggagcagacagcccagcagtctcagtgagactgagatcagagtttaggtgtagaaaagtaggtggggccgggcgtgttggctcacgcctgtaatcccagcactttgggaggccgaggcgggcggatcaggaggtcaagagatcaagaccatcctggccaacatggtgaaaccccgtctctactaaaaatacaaaaattagccaggcgtggtggcacatgcgtgtattcccagctactcgggaggctgaggcaggagaatcacttgaaccagggagtcagaggttgcagtgagccgagatcgcgccactgcactccagcctagcgacagagcaagactccatctcaaaagaaaaagacaataaaagtaggtggaatttgtgcagcaggctactggagagaagagaaatatgcagagaagaagcccaaggaagctatatagggttccccttgagtcttttgggtctcacattacatttagtctccttcagtttgtgatagttcttcagtctttccttctctgccatacccttgacacttttgaaaagtattggtcaggtattttgtccagtgttctcagtatggatttgtctgatacttttttgtgattacattgaggttatggattttttttggaggaataccacagaagtgatgtacccttttcaatacattcgtatcggggtacatgatatcagcatgtcctgttatttggtaacgttaacactgatcatgtggttaaggtggtttttgccagtcttcttgcagtcatctctgagcccagagcctctctgatttatttagtttctcctgagtgtaaatctcctattgccaagggtgagggatttggagatttaaagctcttcttacaggagctttcaaataattcctccatcccccatatcatcctttcctcctgaagtgctgctgattcctgaaggtcagttggcttgaggctcacctgtctgtccctttggaggtacttagattgactctttcccgtgaaataatttacttttcttctatccaccttcttctttcatatattatagattaggattacaatccaaaatatctctcagttttatcagaaatggagtttgtgttcctatttcttgtcctgtttgttgtttgggtgtatttatgaagtggtggacccagaaatgtattcgaccttccatgctaaaactgaagctaaaaatagctttttcagaagacagtatttggcatcatttctcaggcattcaaatacaaacttttgactcagcatttccacttctagcaatttgtcttacagaaatatttacacatggacccaaagataacatgtataggaaagtttatagaagcattgctgatagtagcaaaaaaaaagtaatggaaacagcccaaaaaaaaaggaaaaacaagggaatgattaaataaatggtggtatatctatattgtagaatactattcagcaattagaaataatgaggtttgtctttatgtactgttatgggaacctcctaaagacattacatcatatagcagtttgtaaagcaacatgtttggtatcatttcattcccatatttatgtgtatataaaagtgtgtcattgaaatgaaaaatatttgaaagaatatgcgccaaactattaatagcagtgttttggaggtcatcaaaagggaaccataatctttgtatacttcttaaactttgtatacttctgtaccatatgtattatttttataacaagcatattgcattttgatttttcaataaaaagatgaaatagactacctacagcagtagttgagcaaccactggaggttttcaggcatgggctctttttgttgttgttgttgttggttgaatttgaatgtcattcctgcattggtcatttattggatttctctgtagcatttatttattttcatttttccgtaagttattagggtacaggtggtatttggttacataagttctttagtggtgatctgtgagattttggttcacccatcacctgaacagtatacaatgcaccatatttgtagtcttttgtccctcgcctccctcccaccattctccccaagtccccaaagtccatatcattcttaatgcctttgcgtcctcatagcttagctcccacatgtcggtgagaacatttgatgtttggttttccattcctgagttacttcactttgaataatagcctccagtctcatccaggtcactgcaaatgctgttaatgcattcctttctgtggctgagtagtattccatcgtataaatataccacagtttctttatccactcattgagtaatgggcatttgggttggttccacgattttacagttgcgaattgtgctgctataaacgtgcacatgaaagtatctttttcatataatgacttattttcctctgggtagatacccagtagtgggattgctggatcaaatggtagttctacttttaattcttcaagaaatctccatactgttttccatagtggttgtattagtttacattcccatcagcagtatagaagtgttccctgttcaccgcatccatgacaacatctactgttttttgattttttgattatggccattcttgcaggagtaaggtggtagcgcattgtggttttgatttgcatttccctgatcattagtgatgttgagcattttttcgtatgttggccatttgtgtatcttcatttgagaattgtctgttcatatccttagcccactttttgatgggattttgttttcttactgttttgtttaaattttttgtcgattctggatgttagtcctttgtcagcttgttagtcctttgtcagattgtgaagcttttctcccactctgtgggttgtctgtttactctgctgactgttacttttgctgtgtaaaagctctttagtttaattaagtcccaactatttatttttgtttttattgcatttgcatttgggttcttggtcatgaaatccttgcctaagccaatgtctagaagggtttttccatgttatcttctagaatttttatagtgtcaggtcttagatttaagtccttaatccattttgagttgattttcatataaggtgagagttgaggatccagtttcattctcctacatgtggctagccaattatcccagcaccatttgttgaaaagggtgtcctttccccacttcacgtttttgtttgctttgtcaaagatcagttggctgttaagtatttgggtttgtttccaggttctctattctgttccattggtctgtgtgcctatttttttagcagtaccatgctgttttggtgactatggccttatagtatagtttgaaatcaggtagtgtgatgcctccagatttgttctttttgcttagtcttgctttggctatgtgggcttttttgtttgtttgtttcatatgaattttagaattgttttttctaatttcgtaaagaatgatggtggcattttgaatggggattgcattgaatttgtagattgcttttggcactatgatcattttcacaatattgattctatgcatccatgagcatgggatgcatttccatttgtttgtgttgtctgtgatttctttcagcagtgttttgcagttttccttgtagaggtctttcacctccctgattaggtaaattccaaagtattttgagttttgcagctattataaaaggggttgagttcttgatttgattctctgcttggttgctgttgatgtatagaagagctattgatttatgtacattaatcttgtatccagaaactttgctgaattcttttatcagttctaggagctttctggaggagtctttagggttttcagcgtaaactatcatatcatcagcaaacagtgacagtttgacttcctctttaccgatttggatgccctttatttctttctcttgtctgatttctctggctaggactttccagtactgtgttgaaaagaagtggtgagagtgggcattcttgtcgtgttcctattttcagagggaatgctttcaacttttccccattcagtattatattggctgtgggttagtcacagatggcttttattacattgaagtatgtcccttgtatgctgatttgctgctaacaattttaatcataaagggatactggattttgtcaaatgctttctctgcatctattgagaagatcacatgatttttgtttttaattctgtttatgtggtttatcacatttaattcacttgcgtatgttaaaccatctctgcatccctagtatgaaacacacttgatcatggtggattatctttttgataaattgttggatttggttagctagtattttgttacggattttagcatctatgctaatcaaggatattggtctgtagttttcttttttggttatgtcctttcctggctttggtattaggctgatgctggcttcatagaatgaattagggagggttccctttttctcaatattgtggaatagtgtcaaaaggattggtaccaattcttctttgaatgtctgatagaattctactgtgaaatctgtcttgtcctggacattttttttgttggtaatttttttttaattatactttaagttttagggtacatgtgtacaatgtgcaggctagttacatatgtatacatgtgccatactggtgcactgtacccactaactcgtcatctagcattaggtatatctcccagtgctatccctcccccctccccacaccccacaacagtccccagagtgtgatgttccccttcctgtgtccatgtgttctcattgttcaattcccacctatgagtgagaatatgcagtgtttggttttttgttcttgtgatagtttactgagaatgatgatttctaatttcatccgtgtccctacaaaagacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcggcatgatttatactcctttgggtatatacccagtaatgggatggctgggtcaaatggtatttctagatctagatccctgaggaatagccacactgacttccacaatggttgaactagattacagtcccaccaacagtgtaaaagtcttcccctttctccacatcctctccagcacctgttgtttcctgactttttaatgattgccattctaactggtgtgagatgatatctcattgtggttttgatttgcattgctctgatggccagtgatggtgagcattttttcatgtgttttttggctgcataaatgtcttcttttgagaagtgtctgttcatgtccttcgcccactttttgatggggttgtttttttcttgtaaatttgtttgaattcattgtagattctggatattagccctttgtcagatgagtagattgagaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggtttcaggtctaacatttaagtctttaatccatcttgaactgatttttgtataaggtgtaaggaagggatccagtttcagctttctacatatggctagccagttttcccagcactatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattgccttgggcagtatggccattttcacgatattgattcttcctatccatgagcatggaatgttcttccatttgtttgtatcctcttctatttcattgagcagtggtttgtagttctccttgaagaggtccttcacgtcccttgtaagttggattcctaagtattttattctctttgaagcaattgtgaatgggagttcactcatgatttggctctctgtttgttattggtgtataagaatgcttgtgatttttgtacattgattttgtatcctgagactttgctgaagttgcttatcagcttaaggagattttgggttgagacaatggggttttctagatatacaatcatgtcatctgcaaacagggacaaattgacttcctcttttcctgattgaataccctttatttccttctcctgcctaattgccctggccagaacttccaacactatgttgaataggagtggtgagagagggcatccctgtcttgtgccagttttcaaagggaatgcttccagtttttgcccattcagtatgatagtggctgtgggtttgtcatagatagcttttattattttagatacgtcccatcaatacctaatttattgagagtttttagcatgaacggctgttgaattttgtcaaaggccttttctgcatctgttgaggtaatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttgtattgattggaatagtttcagaaggaatggtaccagttcctccttgtacctctggtagaattcggctgtgattccatctggtcctggactctttttggttggtaagctattgattattgccacaatttcagctcctgttattggtctattcagagattcaacttcttcctggtttagtcttgggagagtgtatgtgtcgaggaatttatccatttcttgtagattttctagtttatttgcatagaggtgattgtagtattccctgatggtagtttgtatttctgtgggatcggtggtgatatcccctttatcattttttattgtgtctatttgattcttctctctttttttattagtcttgctagcagtctatcaattttgttgatcctttcaaaaaaccagctcctggattcattaattttttgaagggttttttgtatctctatctccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagcagtcattcaagagcaggttgttcagtttccatgtagttgagcggctttgagtgagattcttaatcctgagttctagtttgattgcactgtggtctgagagatagtttgttataatttctgttcttttacatttgctgaggagagctttacttcccagtatgtggtcaattttgtaataggtgtggtgtggtgctgaaaaaaatgtatattctgttgatttggggtggagagttctgtagatgtctattaggtctgcttggtgcagagctgagttcaattcctgggtatgcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgatcctgtcagtatgaggttagctggttattttgctcgttagttgatgcagtttcttcctagtctcgatggtctttacattttggcatggttttgcagcagctggtaccggttgttcctttccatgtttagtgcttccttcaggagctcttttagggcaggccttgtggtgacaaaatctctcagcatttgcttgtctgtaaaggattttatttctccttcacttatgaagtttagtttggctggatatgaaattctgggttgaaaattcttttctttaagaatgttgaatattggcccccactctcttctggcttgtatgtagagtttctgccgagagatccactgttagtctgatgggcttccttttatgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcattttcaggtacaccaatcagacgtagatttggtcttttcacatagtcccatatttcttggaggatttgttcgtttctttttattcttttttctctaaacttcccttctcgcttcatttccttcatttcatcttcatcgctgataccctttcttccagttgattgcatcagctcctgaggcttctgcattcttcacgtagttctcgagccttgctttcagctccatcagctcctttaagcacttctctgtattggttattatagttatacattcgtctaaatttttttcaaagttttcaacttctttgcctttggtttgaatttcctcctgtagcttggagtagtttgatcgtctgaagccttcttctctcaactcatcaaagtcattctctatccagctttgttccattgctggtgaggaactgggttcctttggaggaggagaggcgctctgctttttagagtttccagtttttctgctctgttttttccccatctttgtggttttatctacttttggtctttgatgatggtgatgtacagatggatttttggtgtggatgtcctttctgtttgttagttttccttctaacagacaggaccctcagctgcaggtctgttggagtttgctagaggtccactccagaccctgtttgcctgggtatcagcagcagtgtctgcagaacagcggtttttcgtgaaccacgaatgctgctgtctgattgttcctctggaagttttgtctcagaggagtacccggccgtgtgaagtgtcagtctgcccctactggagggtgcctcccagttaggctgctcaggggtcaggggtcagggacccacttgaggaggcagtctgcccgttctcagatctccagctgcgtgctgggagaaccactgctctctgcaaagctgtcagacagggacatttaagtctgcagaggttactgctgtctttttgtttgtctgtgccctgcccccagaggtggagcctacagaggcagacaggcctccttgagctgtggtgggctccacccagttcaagcttccgggctgctttgtttacctaagcaagcctgggcaatggctggcgcccctccccaagccttgctgctgccttgcagtttggtctcagactgctgtgctagcaaacggcgagactctgtgggcgtgggaccctctgagccaggtgcgggatataatctcctggtgcgccgttttttaagcccgtcagaaaagcgcagtattcaggtgggagtgacccaattttccaggtgccgtctgtcacccctttctttgactaggaaagggaactccctgaccccttgcgcttcctgagtgaggcaatgcctcaccctgcttcggctcgcgcacggtgcgctgcacccactgacctgcgcccactgtctggcactccctagtgagatgaacccggtacctcagatggaaatgcagaaatcacccatcttctgcgtcgctcacgctggaagctgtagaccggagctgttcctattcggccatcttcactcctccccctgttggtaatttttttttttttttttttttttttttttttgagacagagtcttgctctgtctcccaggctggagtgcagtggcgcaatcttggctcactgcaagctccatctcctgggttcatgccattctcctgcctcagcctcccgaatagctgggactacaggcacccaccatcacacccagctaattttttgtatttttagtagagacggggtttcaccgtgttagccaggatggtctcaatctcctgacctcgtgatccgcccgcctcagcctcccaaagtcctgggattacaggtgtgagccaccgtgcctggcggtaatttttaaattaccatttcaatctcgctgcttgttattgatctatttagagtatctaattcctgattaaagctaggagggttgtacttttccaggaatttatccatcccttctaggttttctagtttatgtgcataaaggtgttcatagtagtcttgaatgatcttttgtatttcagtggtgtcagttttaattattcctgtttcatttcttaatgagattttttggattttctcttttcttggttaattttgcttatggtctgttggttttatttatcttttcgaagaaccataaataaattgttctttgatgtaaaccaaaataaattttaatttatcttttgtatttttttgtttgtttcagtttcatttagttctgctctgatcttggtactttccttgcttccaccgggtttgggtttggtttgtccttatttctctagttccttgaggtgtgaccttagaatgtcagtttgtgctctttcagtctctgatgtaggcgtttagggctatgaactttccttttagcactccctttgctgtatcccagaggtcttgttagattgtgtcattattgtcattcagtttgaagaattttaaaatttccatcttgatttcgcttttgaaccaaagcaggttttgaacctgctctttcaggagcaggttatttaatttccatgtatttgcatggctttgaaggttccttttgaagttgatttccagttttattccactgtggtctgagagagtgcttgatataatttcagttttcttagatttattgaggctcactttatggcctatcatggagaaagttccatgccctgttgaatagaatgtgtattctgtggttgttggatgaaatgttctgtatatatctgttaagtccatttgttccaaggtatagtttaaatctattgtttctttgttgactttctgtcttgatgacccatctagtgctgtcagtggagtattgaagtcccccactattattttgttgctgtctatcacatttcttaggtctgttagtaattgttttataaatttgggagctccagtgttaggtgcatatatgtttaggattgtgatattttcctgttagacaaggccttttaccattatataatgtccctctttgtctcttttaactgctgttgctttaaagtttgttttgtctgatataagaatagctacccctgctcgcttttggtgtccatttgcatgcaatgcctttttccacccctttaagttcatatgagtccttatgtgtcaggtgagtctcctgaaggcagcagattgttggttggtgagttcttatccattccgcagttgtgtatcttttaagtggagcatttaggccatttacattcagtgttcatattgagatgtgaggtaccattacatgcatcgtgctatttgttgccagtgtaccttggttttttgttttttgtttttgctttttaacttgtacttttgttttatagatcttgtgtgatttatgctttaaagacgttctgctttgatgtgtttccaggatttgattcaagatgtagagctccttttagcggtctcgtagaggtggcttgggtagtggtgagttctttcagcatttgcttgtctggaaaagactgtatctttccttcatatgtgatgcttagtttcactggatacaaaattcttggctgataattgttatgtttgaggaggctgaagatagggccccaatcccttctagcttctagggtttctgctgagaaatcttctgttaatctgataggttttcctttgtaggttacctggtgcttctgtctcacagctcttaagattctttccttagtcttaactgtagataagttaagcacactgatgacagtgtgcttaggtgatgatctttttgcaatgaatttcccaggtgttttttgtgcttcttgtatttggatgtctaggtctctagtaaggccaaagaagtttccctcgaacattttccaaatatgttttccaaactttcagatttctcttcttcctcaggaacaccaattattcttaggtttggttgtttaacataatcccagacttcctggaggctttgttcatattttcttattcttttttctttgtctttgttggattgggttaattggaagaccttgtctttgagctctcaatttctttcttctacttgttcgattctattgctgagactttccagagcattttgcatttctataagtgtgtccaatgtttccagaattttttgttttttctttatgctatctccttgaatatttctctcttcacttcttgtatcattttttggatttccttgcattgagcttcacctttctctggtgcctccctgattaacttaattaacctcctgcattctttttcaggtaaatagggatttcttcttggtttggatccactgctggtgaactagtatgattttttggggggggtgttaaagagcctagttttgtcgtattaccagagttggttttctggttccatctcatttgggtaggttctgtcagagggaacatctagagctgaaggttgttgttcaggtactttggtcccatggggtgttcccttgatgtagtctctcccccttttcctatggatgtggcttcctgagagccaggctgcagtgattgttacctcttttctgggtctagccacccagcaagtctatccagctccaggctggtactgggggttgtctgcacagagtcctgtgatgtgaaccgtctatgggtttctcagctgcggataccagcacctgttccagtggaggtggcaggggggtgaaatggactctgtgagagttcttagctttggtggtttaatgctctatttttgtgctggttgccctcctgccgggagtttgtactttccagagagcatcagctgtggtagtatagagaggaaccagaggtgcgcggggtcctagaacttccaagattatatacccttgtcttcagctaccagagtgagtaggaaaggaccatcaggagggggcggggctagatggtgtctgagctcagactctccttgggcgcgtctccctgcggctgctgtggaggatgggggtgagttaatggagttgtgtacctaggagcattatggctgcctctgctgagtcatgcaggttgtcagggaagtggtggaaagccgcagtcacaggcctcacccagctcccacgcaaaccaaagggccagtctcattctcactgtgccccatctaacagccccgagtctgccagcagttggggagccaggcttgagaacttgccccaggctgcctgcctcccagctgtgaaagaaaagggcttgattcttccccagcctgtggagtctgcacacctgattcgcaccctttcccgagttctggccaggagggttctccccagcttcaaattgttacaaagttcagctggagatttccttctccctgtggtgtttttccccacactcctccggttgccctcccaaaggatccctgtggtgccagttaggaatggcctgcctggggacctagtgagctcccggggcctttctcgctgcttcctctacccctgtattttgcttggctcgctaaattgactcagctccaggtaaggtcggaaacttctccctcaaacaaccttcagtttctccagtggggatgtgtgttcaggagaggagaatctccctttcccacttccacagttggggcacttggggcactcacagtatttggggtgtctcccaggtcctgcatgagcaatccactgccttcagaatccacttcctgtgggtcctctcgggatttctggtttgttcttgcagtcaatctggagcttaaattcacagtgcgagcctccgcacactgctctgtccgtccaagtcggagctgcagtctagtcctgcctctcccgtctgccatggtgatccaaagaatgcctgcatgggctcttttaaagcggctctctgctagacagtatctcaggaagcatttaattcagggatggatccccagactggattactgtttggggaaatagggatttcatgatcaaataagaatgagaaatgctaggttaacaaacagaagaggtgctaggagtcattaacatactaatatgcatggcaaatctctacaatctcccaaatttgattgttgttctcttttttattttacggtatatgtgttaacatttcccaaaagtaatattctgtggaagtatacttttgttcacactgttactatgtttggagtaataagcaccatgtaaatctgactccgttctgaataatgaattctgaataatgttagagtgaacattcctgggaaataacaatttagtagattcctaatgaagggccagagagaaagaatatttcccatgatactttcctacctttcaaatgagcttagaaatttttaaagaaatttcaaaactattttcaaagaaaggttatgaaaaaggaacaaaatttggattccaaaaagaaaatgtaaatgtacctactcacagctgtagttggtgtgagtgggcgtcaaattaggataactggggatctgcttaaccaagggtgcaacatgcctagtgcagaatttaatgatctccaccttcagaaactttcaaatacatgtattggttaaactaataattatagactgttactaagtgacactttatcagtcacaaatctaatgtattgaaactggaaccgtcaaccacagcatagctagattttgaaagttaattctcagaaatattaggagcagctctgatgacttactcaatataaagccgggtcaggccgggcgcagtggctcatacctgtaatcccagcactttgggaggccaagacaggcacatcacttgaggtcaggagttcgagaccagcctgaccaacatggtgaaaccccgtctctgctaaaaatacaaaaattagccgggtatggtggcgcatgcctataatcccagctacccgggaggctgacgcaggagaattgcttgaacccaggaggcagaggctgcagtgagccgagatcacaccactgcactccagcctgggcaacagactccatctcaaaaacaaacaaacaaaaaagccagatcaggagaaacgtcatcattctttaggaacttccacggaacaattcaatttctgctacttacaaccctgtgcaggcccttaggtttcagcgactgggccagtgtgaagctgctgccaagcatttgagcagcaggtcagagcggacagcaatgctcacatttgaaaatgtaataccttttctcaaatagatttcccagtggcctttggcttgattcagatttacatggtgtttacatactgttctaaacatagtagcagtatgaacaaaggtataaaagctgtaaagttccttcttgttaagtaaccaagcaaatcaagagcacatcctgtttaggaaataagcctagaaagcgaggatgggaccagtctggaggactttgaacactgtcctgagatgtttagacttattctggaggctgtttggtacagttacaatgggtgaactttatggtatgtaaatcatacttcagtaaagctgttgaaagaaagactggatagttgaaactattaaacatccttttttttcctagtgtaaaacagcaatagttacacagtcctaggacatttcttttgctcaaaacacctgagcttaaaatctgtctgaagtcttcataaaattaaagtgtccagaaattatcaaagacttttataaatgccaaccagtcatcaagggcccaaagcaaacatgaaaaatacagatctgtaggccacatgtagtaaaaacctttgtttcttagagtcaggctggttgctttcccttctgccaccagagtagttatctcattgcgctcttaatttacatttccctaatgactaatgatgtcattttcatgtgcttattctatgttttctttgatgaaatgactattcaaagctattgcctttttttttttaactttggttgttttcttaatgagttgtaagagttcattatgtattttgggtataagttttttttttttttatcagatacatgatttggaaatattgtctgccagtctgttgcttttcatttacttagttttgggttgttttttgttgttgttgttgtttttgttttgtttttttctgggttttttttagtgcagaagtatttgtttttaatagaatccaatttatcagggcatactttcttttatgtcttgtgcgtttgatgtaacgtataaaaattctttgctaactcaagacatgaagtcttctagaagtttagttcttagattaagactatgagatattttgttaatttttatatatgatgtgagttcattactttgcatgtggatatattgttgtcccagcaccagttgttgaaaagactgttcttcccacattgaaatttcttgacaccttggccaaaaatcaattgaccacaaatataagggtttatttctggacactgaattatctcattgatcgatgtgcctattcatatgtcttgattactgtagctttacagtaaattttgaaattagtaaattttgaagtacagtaaattttgaaatcctccaactttttttgttctttttgataattgatttggctattctaggtcttttgcatttcttctagcattttgcatttcttctagcatgttaatagttgccttattaacaactttgagttgttcaattcatgaacatggactatctatttatttagatcttctttaatttctctctgcaatgtgttgtaattttttctttgtaccagtcttacacttcttttaggtttattcctgagtatcttaaaatttatccctagatatttttgttaaatttatttctaagtattttaattctttttgatgctattgtgagtggaatttgtgaatggaattgatttcttaatttcatttttggattgttcctaaaatatagaactacagttggttttcatatcctccgaccttgctagccttatttattagttttagttgtttttttttttttcagtagattcatgagggttttctgcatagataattatgtcattcacacatgaaaatagtgttatttcttcctttcccatcagtatttcctttttctctttttcttgccattttgcacttgctaggacttttagtactaaggaatgagaaactaatatccttgtcttgtttctaatcttagggaaaaagcatttaatctttcaccattacatacagtgctcactgtaggcttttcaggttgaggaattttacttcttttcctagtttgttgagagtttttatcatgaatgggtgtttcattttgtcaaatgctttttctgtgtctagtgagataactagtggtttttcttttttctcttaatgtgatgtgtttaattgattttggaacattaaactgtcttgaattcctatgataaattctacttggtcatggcatataattttttaatgtgttaccaaatgtggcttgctaacattttggtaaggagttttatactatgatcataagggatactggtctgttgctttcttttcatgtgtcgtgtttctttcttttctttgtcgggctttgataacagagtaatactgaacgcacaggaatgagttgggacatgtttctccttctctatttcctgaaaaagtttgtgaaggattagtattatttctcttttcaaatatttgataacatccagcagtaaagccatttggacttagaattttctttgtataggaagatttttacttactaattcagtttctctattataggtcgttcagacttcatgttttttcttgatagatttggcagtttatgttcttctaagaatttttccccttcctctaatatgtctgattggttggcaattttttttcccaaaatattccattaaagcttttttagttatctgtagggttggtagtattgtactattgtcccttcttgtattcttgatttgagtaacttgtgtcttctcttagtttcctagtcttctacctgagatagaagcttaggtaattcatttgagacctctcttctttctgatgtaggtaaagcactacatttcccttaaagcaccactctagctgcatcctgtaatttttaatacattgtgtttttatttttatagtgttaaaaaattgtgtttttgaggcagagtctcacaatcacccaggctggactgcagtggtacaattatgacccactgcagcctcaacctcctgcattcaagtgatcctcctgcctcagcttctcaagtagctgggactacaggtgcacaccagcatgcctggataattctttgtattttttgtagagatggggtctcactatgttgcccaggctggtcttaaatttctgggctcaagtgatccaccacttcagcctcccaaagtgctgggtttatataggcataagccaccatgcctggcctgttaaaaaaatttttttaaatttttcttatgatttcttctttgaccctaggattgtttaagagcatgtttaattttcaaatatttggggttttctcagatttctttttaattctgtcattttttgctttcatattttggggcttttttgttagatatgtatgcatttataattattatattcaaagaagaaataacataattcaataataattgcagatttcaatattctgtcaaaaactgctaaaactattagacaaagttaggaaggatataaaatagttaaataacgctgtcaaccagcttgacctaactgacattatgaatcttcataatcttctttataagaatctgcagatacagatttttttcaggcacacatggaacaacctccaggatagaccacatgctaggacacaaaacaagtctcaatacattttaaaagaccaaaataatatatagtgtgttctctgaccacaacagaattaaattagatatccacagtaagcctgctgtttgtctggggcctgcttcctcttgctataaaagtagtaaacaggtcacatgtggtggctcctgcctgtaatcccagcacttttgagaggccgaagtgggtggattgcatgagctcaggagttcaagaccagcctgggcaacatggtgaaaccccatctctactaaaagtacaaaaaattagccaggcgtggatgtgcatgcctgtggtcctagctgctcagggaggctgaggtgagcctgagaggcggaggctgcagtgagccatgattgtgccactgcactccagcctgggtgatagagcaagaccctgaatatgcaggcatccatcctggcccctccgtattgccttcatgggactttgggggcatgggaaactgaccaaaacaaacgagaaactctagctgcctccactgccatgagtaataaagttctttgtctctgatgcagcacttgtaccatctgccagcacccatgaatcagtaataagctaacttgttagcttatcaataaggtaaactctcagatcctgcttagttcctgacagtttctttagttcttagaatatatttaaatagccactttgaagtctttgttaaatccagtatctgaggacattccaagaaagacattttgtaatgactgcctttgtaatgactgccttttttaccccttgattatgagtcacactttatttctttgcatgtctcttcacttttgttgaatattggatattttggataataaattgtagcaactgtggattctgactcttcctcccaccccctagcagtttttcttgttttgtttgtttaataacttgcctgtactaaatctgtgatttctgcctctcccagggtgtgcaaccacagatgtttttgttgagtatttagttttgattatctttttatttgcattttctaaaagtctctgtttagattttgccctgtgtctgtatagattagtgctgaaccaaagattagtcagcagttatgctcaaatacctcaagccaataagcctaccactttgagctgatgggtctttgtgtggtttggggagtgcattcaaaatctggattattttttagtttgcccagcctttgctttctaccgggctctctcagttgtcttgtgaacacacacacacaggtttcatctgccgggggtgtgtgagtggcttgggcctgctgcagtccctagggtacatacacatggccttcagtcaacctaggatatgtgcagaggttaccaagccttctcaccactttctcacctcatggaataccttgttccatggctagtctaccatccattgcttgcctcaatgagatacaacctcaggccagcagagcactggcccttcctattcacttgccaccaggattgctcctctaattgacaacactccatatcaaatgagctcttctggcaacagcagcaaagccactggtttgtagggcctgcgctagcctggttgaacaatcactctagcagagctagagggggatgcctcagacactgtttgtgtgtgaagtctggtaattttcatgaacagatgcttctcagcttgttatatgtctttggtcagtttccagtttttgacagtttttttccgctttatagttgctttgggggaagaggatttgtcagtctcaaaccatcatgccaggagtctaaagtcccaatctacatcatcttgccattgatgctagtgtaacttaactgcctgtttgatactctgtgataacataagttgctttctcttacctgctcagctaggatatggaacagcagcaatagaatcaacctggggaaagctgatagagaacactggggccacagtgggcatggatttttcccatggttaattaggaatgatttacaatgatcaggcattttttatacttttattccctgtataactaataaaacatttgctttacaaatggtatatcattatataaatgttatttatatacactttgtgtcaaccaaagagattaaaatattgccttttgtaatgagattctagaaacattgtcttcatcgtactcatgttctccctgaatttccttccatttattaattcaataaatgtacacttggttatctaaagtatacagaggcatgttgagtgattcccagatgaaattgatacatattttgtccttaaggagcttatagattcgtggaagtaatacaatgtaaacatgaaaaatggaaatagggtgtgctggatgccgttaaagagttatagatctgtgctatggaagttcagtagggtaactgagttttccctatctaagtgattctgttatcactcattactcccatcacctcgtcctccctgcttgcattccctccccagctgctttcctactgaaatccttatgttgttactcattcaagctagtcatagtaaataacatgtacgcagagcttccacatgcacttttcttgtttggtatttgtctggttcatatcagcttggggtttaggtagggagcattattattcctaatttacagataaggaaactgacatcagagtgatttacccaacctcgcatattagaagagtcaagttttgaacataagtctttgtactcgaagtcctgggctctttccggtatgctctgctgcctctcacacagcaaactttctctcctctctagccagtagatagttgggaagaattaagtttggtgagttgggtcagaattggaggcagcttagtgtgtttctagatggacatgcaaatgaggctgcaaagcaagactgttcaggctactttttgaatcatttcccaataagggtttttaatgacttttaattttacaataatcggagatccatattttcatttgcatctcatttattccataggtgttgaattgtgactttaaacacagcatattcaaaaccaaattcataatctccccctcaatctgttgtcttctctgttaatgacacctcaggctccacagtctcctaagctagtaacttggaagtctttgactccttcctaacctttatctcagcatctaatcctatcgtttccagcctacctcatagggttattgtgtgagtaaactgacaaaatatataaagacaaactctgaaagctgtgaatgagaggtatttatttcctctaaggcagtgcatctgttgatgtgtacagtactacaaggcctcagcaaccattcagagttaatgttttgtagtgttgacacttgctttagtgaagcatgtacttaacgtcggggctaaaactgcattatcttacattcttataacaatctgcactcttaaaagcactaccaagggaggagaaaaaaaaagggagcatgagagagaacaaggctctcttttgtgatttgcacaagaactggaagtcaagttttcagactctgcttggctatatccagaggtcttttaaactgaaaaccaaagttgattttattaataccactccaccactcattctctgtgacctagggcaagtgatttagcaatgtcagtctctacatataagttagagataatgattgtacctattttatagagctgctgtaaggattgaatgatctatatagagagccagagtgccatatgtaaggtattcaagaagtggtagctattggattactcttctccctttccacctatctagagattttaggttggtcctcctttgccatttccctgagatagataatttatttcacgtggcgtatttatttagactgcatcacattacactctcgcagttcacagacatttccaggaggttgttgctccaccacttcattcaaaactaggttcacggttttcatgttttcctctctacatctctcctactaatttcccttttaatgttcgaacatgattctgatgaagtctttcagttaaaaattgtgagattaaacttgtactctctaactccgaagtgaaagagattttaggttcaatattaggaataaaattctactatcaggactgttgtttttgtttttcatcagtagcatgggctgccttggaagttatgaagttacccatggctaccgctatacaaaagtggcttttgactagcagctttgcctcgccactgcttcctttctcccatccagtccttgaggtctgcaagctgtttcagtatacatcgcagtgaagagtgtaacaaacagattagctacctgacttgcaattttttggctttggaatttttggttcaggattttatactgtcctagctaaatgaattgacaaaacagcaaggtataacttacaatgaagaagtttatcaaccttcccccgcaggattaccaaatacagaggtgcagggtttaatattagactaaagttgaagatgtggccctcaattctcctgcaaaggagctctgcagtgaagtcacaatagccatgagcctctcagtgtaactagggtcatccatactattccatatgttaaagtagaagaaaatagtgaagtcttgtcatttgcaagacttttatgcaaagtttgacagatgttgcatgctgctttcaggattaagaaaattacatgggcactgctgtgccttctgtgagaagttttattctcagctgtcaccctccttgtcccttgcccataaccattatagtggccagaaagtctgcttgctctacagtgatgtgttttgaatagtgcccattagttttcagtagttaccctggcctgcatgttagccttcagtttaatggccttttttatgttcattcattttattttatttcccatcgtggttttgtttatttcttttttgttttttgttttttctgttctcttttttaaaaccgtcgtggtttgcccttcatattccccaatgtttgcacatgacaagatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctaggtaagtgcctgtgtgtctgcagccagttggctgcctcttggtcacggcagccttgtcatgctcaccctggctcttggtatctgtaccaatttttagtccagaaaataagatcactgagatgcaccttccctaattttaggtcattaaataaactcccaaacagactaaagtcctggtagtctctccttttctgggatgacttagggagagggtagatacagctattgaggtggacgtatttaaatgtaagaaggagtgcccttttttcataagattcagtcagtataaattctagagattaaggtagacttaatttattaaagtaaacttaaatgaatatttgccacacccttatgtggtgtgggctgcggagctccaggggttctccttgatggaataagagtagttagtgatgacttttcctaaaatagcattttcattacattcctcttcatttccaccccctcaggagctcacattgctcataggggaagatctataatgtccaggctgctttgtgccacaggctggcttcactttatctgtccaacttgcttttcctttttccccaatgtaactgactttctagtgaaaccagtctaatcactatagcctttttttccagtgtgtcctcttcagtcacttcttgcccctttctcagctgaaggtaaattcagttaatccttcttggcccaggttaagccccatgaagctctcaaagatctttacccaccttttcagcacatagagcatttcccttgtacgtgtatttgtatccctaatattggcacttgattatggtaatatgtgatattttactaccttaagctgttattcttcaattatgttctatgtatttgtgctgttttcccaaccagattataaactctttggaaggaaccatgccacatgctgactgttcacacattgccgagtagtaaattccttcactgtgctcttccaaccagaataagaaagctaagatacgtgttttagtaggagccctaatacatcagctaaagcttgtatttccattagcatgcttatagttgatgtacattgtagttaataccagactggcaagtttagcaagtgcaggaccctttctttaatactctcaagaagtctaagtggcataatttaacaccaacagatgggagttacctgaatgctatactgtgtgttttgagttttacaagggtagagaaacatagttctatacataaaaaaaggtaagacattcctaccaaacagcaagtttcaatatcaccattaaaatatcttcaatagactttgaaatctcattgaaaatctcataagctttcacagaaggaagaaaccatttagtaattctgcgtaataagctttatttctgcagtaggttttttgctcttattgtgcgttctaccagaaatgcattttcctcacatgagttacatctggcttcttatctatcatctttagatgacatctcctcaggccttccctgaataccaacccaaacttagcccctcggtgactgtcacacagtggggtatcagagccagcctgttcccaagctaattgttaaatgctcgggaaattttgcaaacctaatgacatgacttggcagcttgaaattgggcatggtgggagtgtttacagtgacaaatgctgcaaaccagagccaattgttaaacattcaccagaacaccactgctgtcacatcaccctattttttggtatgtgtgtggtatttttttgtttgtttcgcttttagtttgggtttttttttttttttttttttttttttttgagagcacttactactctctgaaattttctcttttattagcttatttattctgtctgtcttgttcaataaaattctccagcacctggaacagagcctggcatttagtaacactcagtaaatatttattaagttaatacattaatttcaattcgtggagaaataatagataattcaagtaatcatgttgagattgattatccatttggtgggaaaaataaaagttatgtctctgtcttaaattatagatggattaagagataaatatttttaaaatctataaatatattagaagaaaatatagaaatgatttttatcatttggagaacaggaaagggcttttaaagggagatagcaaatccagaagccataacaggaaagagtaacaaagttacaaattataaataaaagatatcccaagagacaaataatacaagcagatgattcatagtactggaaagcccattagagttaaaaaaaggttttcaccatctcaggcgatcttggaagcaaaatgatgggggtttttttgtttgtttttattttgttttgttttgttttgttttggagacaaaggtctcgctgggtcacccaggctggagtgcagtggcactatattggctcactgcagcctccgcttcccaggttccagcgattctcctgcctcagcctcccaagtagctggaattacaggtgcctgccaccatgcctgggtaatttttgtatttttagtagagatggggtttcaccgtgttagccaggctggtatcggactcctgacctcaggcgatccacttcagcctcccaaagtgctggaattacaggcatgagccactgtgcctggccaagttatcatttttcatctataaagctggcaaaaattttaagttgataatatccagtgttcaatgagttgacagctaggaggaaaaccactctaggttattggtggcagtataaattagaatagtctagggaaggtgatttggcagaattttaaaatattttaaatatacatagccttccatcacacttctaggtaactgtcctatagacatacagatatatgtatgcattgggccctcatacaaacacgtttatttatagcattgtttgcaagattataaaaggagactatgtaaatatccactgatagaagaatgggcacctaatatacaatcgtgcatcacataacaacgcttcagtcagacagactgcgtatacaatggtgatcccataagattataccactgtctttttactgtaccttttctgtgtttagacacatagacacttgccattgtgttcgcattgcctacagcgttcagtacagtaacatgctgtgcaggttcgtagcctagaagcaataggctatcccatacagcctaggtgtgtgggatatacacctagctataccatcgaggtttgcataagtgcattctgtgatgttcacacgatgaaatcacgtgatgcatttgtcagaacatatccctgttgttaagcagtgcatgactgtatgtatacccgtaagtatggtggcagcagttttttttaaatgacctgtctgtatattttgatgtgtatgtaaatgcctaaagcagtgatcctcaaccagggacagttttgccccctcatccctcgggatatttggcaatgcctggtacagcgtcagtaagtaccagtagaggtacttactgacatctagtggatagaggccagggatgctgatgaacatcctgccatgcacaggacagtcccacaacaaagaattatcctgcccaatgtctcagtagtgccaaggttgagaaaccctggcatggagactgtctggtgagatatgcgtcaatatgtgccacagtcagctctcagggcaggacaggttttgacaaaagagaattgagacttatttttttttaactgtgtgtacttttatatttaaatgttttcaatgagacacacttatttaaattttatgatagattgtgggttggagtaagcaggaatgattagtaaattaatttgtagttggaagagatacagaagttgagttggcaggggcaggtgggcatgactagtgtatgtaaaggaagaggaagtgcaaggtaaggccatctgtgtgtatgctgtgagaaggatgcaaaggcaagaaagctggccaaactggcccagagcttttggcagaaattagtaagagattagaataaagtggacgtttggagccagatgctggaatgccagtgagaatttggacataatcagataagaagggaccatttttgactgttaagaaagttgtacactgtgattttattaaacagtactttgggaacactacccaagattaaaggagagaaaaaatagagtcagggagacaaaattgggtagtaattatgttagcctagatacgtgctagtcgtcggcttggatgaagatgaaagcagcgacttgaagtggataggacaaatttgggaaatatttaaaaggaagattttgggagaccataatagttttttgttgcttcattactttatgatttctgaatagaggcaatgaaggagaagttaatttttttaagtcgtaagactatatcctggctaattgttacataaacaaaactttcttattaatcttatcggcttaaattttctcatctaaaaaacaaaagtaatatatttacttcacagacgtgtggtaagaattcaatgtgagaatgtatgccactacctgcatttacaaattcacccacttcctgcatttgaaaattcagccaccaggtggcaccatatgccttggtcatgagctgtaattcttatgggtacctgagttgccagagatttcagagggtccttcctctctgccttttcagctatgaaaatttcatctttcttaaaaaagcagtacttttctatattaaccattaagtgggaagtggaaagtaaggtatttctgctattcatagcactttaaagttggattgaagccttagagatctgttagtctagtcaaggggttagcaaaccatggaccctgtgccaaattggagcaattatttatttttatggccccggagctaagaatagtttttacatttttaaatagttacatttgaaatgttacataggtaactatataatatcctccattttgcctcttggcctataaatatttactaccaggccctttaagaaaaagtttgcccaccctgtctcattttttcgtttaatacataaagaaagtgaggcccagaaagcattagtgacttttcctcacaagctagtagcattgccagaactagaattgcatctcctaacttccagcccagtgctttctttctataaagtgtgcccttttctttcccttttgattcttagctttcacattctaacctgagtcccactgtaaccccacacacttaagagaattgttgtttcaaatgctccttgaatcttatcccaaaaccaagggtggtttttctgcacagtaacttgtttctgggacctcagaccaatagtgtcagatcacctatgactgattttttttaatggtaatgcttctatagaaatttgatgtgggtattagtaaccttcacttatttctcccattttttccctttcacatagaagcaaacaaaaaatatatatatgatattagtatacaagatttacatatcagaaggcagattttcgtttattcattcaatgtatgtttgggatgcagcttccctgtatgagcattctgctacgtgcttctgtcgtacacgaacatgaatgagacagtcttttacttcagtttgaagtaaaatagtccccctcctgtgtctttctagaagaaaacttgtttcaactttcctgtgtggggtgaacaaaagagacctgatctgtactctctcagagagcctttagtttagtgtaaaatacaatacagttgactccccagaacttaaccactagtagcctactgttgactggaagccttgccaataacatcaacagtctgttagtacatatttttatgttatatgtattatatacggtattcttgcagtaaagtaagctagagaaaaaatgttattaaaaaaatcataagggaccaggtgtggtggttcatgcctatagtctcagcactttgggaggctgaggcgggtggatcgcctgaggccaggagtttgagaccagcctggccaacatggcaaaactttgtctctactaaaaatacaaaaattagccgggcgtggtggtgtgcacctgtagtcccagctacgtactggaggccagggcacaagaatcccttggacccaggaggtggaggcttcagtgagccaagatcacaccagagcactccagcctgggtgacagagtgagaccctgtctcaaaacaaacaaacaaaaaaatcttaagagaaactatttattgtacattaagtgaaagtagatgatcctaaaggtcttcaccttcaggttgagtagactgaaaaggaggaagaagaagaaaaggggttggtcttattgtctcaggagtagcagaggcagaagaggtggaggaaatggaagcagggcaggaaaggcaggcgcactcggtgtaacttctgttgaaaaatatccgcttatacgtggacctacacagttcaaacctgtcttgttcaagcatcagctgtacttccctttaagacagggatcatccatgatcagaccaagtgtcagaaaccttaaattgtaagaaatcagttgatccttccttataaatcctgtgattgagagatttagccgaagagaaaatagtattaggtatctcaagtatctctgaaaaataatttttgttactacagtattcttttccaggggacctagctgattatagagaaaaaatcctctgtaaatattgtgtgggtactattgttggattttttaattaaaataaagtaacttaaaagaactatagaaaattaccaaaaagcacttctctgcagtgcaaatgctcacaatcagacaaattggcatatggtcatgtagacctacacaaattttaatctgcaatttgaaggcaaattatcagtattttaaagtaagaattttaattcaataaattagaataatttcttcaatggagtagtttgaggctctttaattactttctcaagacaggtatagctgtttcctcacatgaatgacagttcctaaaagccaactgtttgtctaaaacaaattccttcacaatatttgttgaaaactcttgattatgcagtctggttttcattctagtgagtacagtagactgagcatgtttgtggacctgtgttggtcacacagaccccaagacagaacctggaagccacctttagtaaagaacctagataactggttttaagctttcatctcatgatattaaatactagaccgctggatttgagttgtttgtgataaagtttgtcaaacatttcatatcatttcatatcagcttcaaaatcaatgaagtgttaattttaagaaattataaaaatcagtattgtaatcagtttattttatagactgggttacacttaggatttatttaaatgttttatgtttttatttccaattttaaaagatgataacctctagcattctttttattgagagtctcttagccaaaatatacacagcattctttgatattttctgtgaaatatcattaggtcataccaatatccaccttccatcaatttccctaaaactcagtgatttctaaagcctagaaagttgatgactagctgccccatttgaaatggcattgagaagagccctgtgtcttctctgaaaggaagttgtgattatggtcagcgatatcagtaacatttcagcaagaacatcactgatttgtcagatacgtatgcccttgctcttttgccagtccccatcttctttgcactgtcctacccccaaaagcttcattgtttgagagctaatttgacttacactgatagatttttatgtggagtggaaaatgaaactgtacattctggaagtattcctaattaatgctatctctctccaaatcctttgtctaaagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgagggtaagtcttccacctgtctgtcagcaccccctagaggtagacctctctgaagttctacctttgtttagccttgcacaccataggggagcagaagataacagttccttactttcggggtccttatcaattaggggaggcaaaattaatttacatcaaaaaacagcaagtagggctgggtgtagtggctcatgcctgtaatccaagcactttgggaggccgaggcaagcagatcacctgaggtcaggttttttagaccagcctggccaacatggtgaaaccccatctctactaaaaatacaaaaattagccgggtatggtagtgggtgcctgtaatcccagctactcgggagaatagctgaggcaggagaatcacctgaacccaagaggtggaggttgcagtgagctgagattgcaccactgtactccagtctgggtgacagagtgagactctgtctcaaaaaaaaaaaaaaaaaaaaaaaaaaaaacaacagcaaatagtataagacaatatacttctgttggtgcttttctacgtgttcatattttactgaccctttaagacttagctcagatgccttctagaatctttcctctgattctaatattgttatctccacagtctaagatatttatcacgtttttccttcagttatgattatgaacttaccttgctgattttgtagcaaagacagagcctttgtcatccttacatttcccacagtgtctaatgtaatgccttgcacatgaagaaggtatttaataattgttcttaactggattgtctgtctttaggcataccatgctctttagaatctccttgaggctttattttggacctgtggtctttcgtgctaaatagggttacttctaattacatttctaagattttcagtgacgtgagtgtcaatcaggtttatttatattataaatgtgttgtatatcttaagtttggattgtaaactaactataggaccgaaattacaagcagccagatcttaataaatgcttttcctacttgaggcttttgtctagacttttgctttcttttaacacaaattactgtttttcctcagtgtattcttttttttttttttgaggcggagtctcgctctgtcgcccaggctggagtgcagtggcacagtctctgctcactgcaagctctgcctcctgggttcacgccattctcttgcctcagcctcctgagtagctgggactacaggtgcctgccaccatgcctagctaatttttttttttttgtatttttagtagagacggggtttcactgtgttagctaggatggtctcaatctcctgacctcgtgatccgcccgcctcggcctcgcaaagtgctgggattacaagcatgagccatcgcacccggccacctcagtgtattcttcagtctaattttattattaacagcattagtttttctgtattaaaaacctccagtaataataaaatattttactttgggtagagagtattttagatatatttgtagaggctactgaccaggcagctgaacagaataaatgactttaccagtggaactatagaaataatttaagaactttacctgacgggtagaataagtgaagaagctgtagaacttcactttctaatgctatggcatatcattcacctgtcaaatatttattgagtatcccctatactgggtaatgtgcaagatactggagatgcaaggatgaacaagcttggtcttcttcccttaaagaaggagcaggcaaggtaggagacctttcatcatttcagtgacagagattgaagataagaatcaaacccaggcaagaacaagagggccatcacagagtcagggggttgatttaagggaagagtgtgttctcattacaggcagaatgttgaattttacagttacctatgttcagacaagagcaggaatactctattaggtttcaagctcagttacccttcatcagctttcatatagaggcatcattcatgagagatactaggatacagaatagagaaaacttactgtaaaagatagaaaagtcaaggcaggatcctagggaaagatgagacctgaggctggccttgaggcatttgacttagagcaagcattttgtgggaaggaatttgcatgacccaaatcccagaaatagaatctaacagtgcacatgcaaggtaagtcatgacaaaaatgaaggaaatgcaagggtcctatcctgaggctgtgaaccttctgaaactgcatgaaaataaatatttgtgtctgtacatattcacatttcccttggaaaggatctgtagttttcattgtcatttcagagctcatacatcagattgttgagaaccactgcgagggtcattgtcaaatttagagatgaaagaaaaggggtgaagaagagtggatttattgagtgcccaccatgtgtcagccactgtgttaggcagtcaggatgtaaagatgagtaagacttgacttctgtccacaaggagcttacggtctggtaccatagacaacagtgtgatgtgttatcaccttaaggaaaataggcagcataaccatttattcaaggagtttggctaaaagaaaatagttgtaagaatgtaggtagaaaaggcaacaggttctggtgagggtattttagggatggagaagagactataacatgttttggcaaaagagaagcagtttctgaagagagatttggatttcatctggaggtgttcagcttgtgtgggggaggcataaatgttggaaccagcccttggaaaatattttacatatttagtttcacaaaccaacttaacattttttccatttattatgccactgtacagctgaaatgaaagaattcattagcaccttttttaggatcatatttgcctacacttggccaatgaatatattgaaaatgatttcaagagaatttagggactgttttgtttttcttctcctttaataagttagaggaaagttttccatagcagcagaagtgtgacaaatcccacctgtcaggctgcacaaaatatgcccttaactgaagtgaataacgtgattcataactaaagcaaacaactgttagagtaaccatattcagatttctctactttgatagcaaaattaatcttaagctgtggtgctgttattcaggaaagccagtgtgttttacattttgttagctttttttcccttcccagtttttaaatctaatgaatgtctattacagaaacactagtgccagagaaattgttttcaaatatagaatgtctaccaaagtgtaggcatagacagccacacaggatttgtgtataaattggaactggaacctgtcagtcagacaaaaataatacagtaaaagggtaggtgtgtgagccattgtaggagatagagccagctagacacttaagcagtcagccagtgatccagtcttccagtcacatacatcctatcgtgggtattgtagtaatctccttacgggtcttcttgagcccacgttttagaatcagcaagtactcgactcctgggtccaccgctagctaactttcccatcacttgggaaagattgttaacttcataacctcacctgtaaatgagggtgataatattcatctcacttggtttagtgcaaagattatatgagaaaatacatgtcaagtatttagtgcttgactgactgtaaccattcaataaatggtagctgttttacaattattattattttatctagtcttgttcttttactgtttttcttccatgcatgtgttcacatgtcctttctaaacacagatctgatcatatcatgctcctgctcataatttttcagtagtcacctaacacctactagagaaaatgtgagcttcaatagcaggacattagagggttcttcactatctgactagtcattgttttcaacattctctctcccatatccactctgtttcaaccaagctgaaccacttaacactgtctttttgtatattctccctattgaccccattgactggaatgattttccccttggtatctgaggaaagtgttcattttgcttgactccaagaattcttcatcaaaggggtttccctcccaaacccctcccaaagcagaattgtgtgctctcatctttctgtttttgttataaccgttacctaaatctgttagcacttacgacattttttgtaactgtttatatgtctgactttcctgctagactgggagttctttgtgggcaggattctattcatcactgtatccctagtggctaccacaatgcccggcaaaagaaggatctctttctgtggtggttgccttttatgtcttgtgtaggcccactgcaaaactgggattttataaatcacaaggaaagtttttcagtgtaatttctggttttgatttgaatcataaaaaggaaaatgtgtttatatattattctaaaaccacttcaatcaaatccattgttttcttagcttctattattttaaaaacgtggccaatatgacagtattgccaagaatggttattgaggagtgtagcatttcatttatatcttgctttctcgaacttttctttctagttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggtatgaagtgaagcaacttttcaaaccattgattggaatagtagagttgaaatatatttccaaaactcagtagttgcttgactggaaatgtgagggggaaaaagaaacataggaaatgaaaagttgacagattctatttctttgtaccaagatttattgtgtagtttttaccagcagtggtcagtgaacatcaagcagtatttctaagtaaattgtcaatttatgattcatctgctttgactattgaagaaccttatgtagaagggataaaatctgtttcatgtagaatatagaatttgtgtagctaattctttaattttcaacttttcttttggcttgagtgcatatgtataaagtgttttattttattcaaggatgttgatgtttcaagtcactcttacaccattaatgggttgaaaaaatatacagagtatagtttccgagtggtggcctacaataaacatggtcctggagtttccacaccagatgttgctgttcgaacattgtcagatggtgagtctttcttcctctggaacgatataccacacttggtgcccctagtggtttagttgtaagatcatgagctttgatgtctagaagattcagttcaaatcccaattttacctctttctggtaatatgactttagtcaagtctgaacatcttttttcacgtgtaaaatgtagataataccaacttcattgagttgctgtaaagattcagtgagaaagcatagagcataaagtgcctcttactggataggctctcagcgtttgtgtttttagcagaagcttttgtgtaagtaaatactattgcttgttcataacacagaccattccagggcttttggaagactagccttattctacttagcaatgatatttgcatgccaaattagtctttctagttcctccgtatttgtgactgttttatctctcacctgtgactgaatttctaaattaagttatatatatatatacacccatatatatgtatatacacccatgacctagagcagtgtttttcgaactacagcttgccaaagagattaagtaggtcaaaaccagcatttaaaaaaaatatatttttagaatagaacagaaaagattagagttcattgcacttagtaagggtatatgttgtttcatgaaactcagctaaatcttatgttttagaaaaatgtctttttaaaaaaacgtatttatgtgtataccgctcttacgtaaacacacatgctttagaaggtaaagtttgactcccttaagaaaagagtcaaacttaacatcaccaataaaagaacagactgacatcacgtgcccccttatgtgatacatggaggaagacacaatattacttctgttatatcagtaccaaaaatatttaacttgaatctgatcatgatgaaacaatcagacaaatccaaattgagggaagctctgcaaaaaaaatttttattttaactgacttggattcttaaaatatattagttttgtgaaagaaaaaaaaggttgaggaatcattctagaatctagattaaagaagagtaaagacacatgaaataaaatatgtatgatctttggatcctgcatctggagataaaaaaacagccataaaggacactattggtataattacttaatattagatacatatggtattaggcaatagtaaatattagatatgttattagctatattagataatatttttgtgttaaaatttctgaatgtgattgttgtattgtgtactttgttggagaatgtccttgttcataggagatacatggcgatatacactgaagaattttggagtgaagtatgatgactgcagtcatctctcagatgattcagaaacaatatgtagatagataaatctgtatacatatacataatagtaagataaataaaacagttgttgcagaatattagtaattgtgaatttgaaaagaacagccattcattgtactattcttgccactgttttccatgggcttgacagttttcaggattaaaaagttgggaggcttggtgcagtggctcatgcctgtaatcccagcactttgggaggccaagtcgggcaacttacttgagcccaagagttcaagaccagcctggacaacatgacaaaacgccatctctacttaaaaaataataataatagctgggcattagtggcacacacctttaatcctagtactcaggaggctgaggtgggagggtcacctgagcccggggaggtcaaggcttcagtgagctgtgattacaccactgcactccagcctggatgacagagtgagaagctgtctcaaaaaaaaaaaaaaaaaaaagttgggaaaaagaaacaaataaattacaggcggttataccttagctagtgaactacataagccagttaggcaagatactggggaaaagttaagggaaaaaaatgtttactgtaggctgttaaatctacacacgagccaaattttaactgcattaagtgtgttggcatgttgactacagtacctgtgggaactgaacacatctcagcatggtggctaggggcagcactttggaataacgcaaatcttggttccgatgccaggtgaaacaaatatcttggacaagttaacttccctgaacctcttctatagttttctgatctacaaaataggaatgagaatagaaactccgtcctgagattattataaggaataagtgtctgccatgtaatgaccatgcagcaaatctttgctatgatgttgataatgaagacaatgatgacagatatgttggatacctctgcaacctcagtcacttcttaacatggagatgactggaatcattaatgtaattttttcaaaacacatgtgcctgggtcctactccagactacctgaatctctgagtttaggcttgaggcactttgctaggcacaagttacagaaaggagcaagacacattctcttgtcttccagaagctatagcacagtgggcacttagttgtatacctggtcaccaaatgttagagacagaaaaagagaagtttccacgggtggattaggagagaagggctaaagtcagcaatttgtaagtgcagagaaaacaaatccggtttactttgcttgctctcaccaatatgaagggagatactagagaatgtgtgggccacacactgagataactctggattatgttctaaagtgaggaactaaagttacgtggctgtttaaccaacagtcccaaacttctcacatctaaatgagtattttctggtatctggttgcctcaggaaaccagatggttcactttaccagttgtcattgcttaaatatctttgctgtacttgggaactgccttcaaaaccagcttagaaactccacaagaaagccaggcttactgatgtatgtacatctcattttgatccatcatgtcattacccagttcagtcacttgccatattccttagacctggttccagaaaaacctatggttgtctgccaagataaagatagaccagggccaggcacggtggctcatgcctgtaatcccagcactttgagaggccgaggcagatggatcacctgaggtcaggagttcaagaccagcctggccaacatggtgaaaccccgtctctactaaaaatacaaaaattagccgggcgtggtagcaggcttctgtaatcctggctactcaggaggctgaggcaggagaatcgcttgaacccaggaggcagaggttgctgtgagccgacatcacgccattgtgctccagcctgggcaacaagggtgaaacttagtctcaaaacaaaacaaaacaaaacaaaaagataaaccatcaccaataatactcaaaagaatacatttaaggttctgagtacatatggggtctagaaaagttgagagtctttagaagagttcagagctactgtacatccttgaaataaatatctgacttcccaaaggtacagcctggcttgggtgtaggtgctttcccatatgaaagtgtcttatgttaaaaattgaaccaggcatggctatatgtcatccacatagtattgtcaacatgagggcattggcagctagtttagatctggtcacgtaatcagtgtttgagatgtgcatttgtttaaagtccagccaagatgatcacatgatgggtgatgtatgggtgattaaaaaaaaaattttttttttttttttgtttctctagttcccagtgctgctcctcagaatctgtccttggaagtgagaaattcaaaggtaaaactgtatgatgctgctgttcatttttactggtatactgttgcgcctcagaggggcttatagaaagggagattctgtaggaaagcatcaaaataaatgaatggcgatgtggtaataatctgcatttaaaaataccaaacctataaattagaacgtaagtgaaaaaaatcacaagcaaagaagtaaaaagacatagatattacacttgcattaaagctgggcttaaaaacccactcatttattctccttaattttgcttccttcctctgacaccaaaactgctttaacatttctgcaattaaattgctctttttctgtaaaacattacattctagatgttaactgttcagaaccttagtggtacggcagaaggaaataagttgtttataacatggttccttagtgctgtgagatgagccatgtgaatcaaaggcagacctctgtcagattggttgtatctcctcaaactgtccttcctatagccaagtttgctgtgttcttaggggccatgtttgcctctcagaggcccagagcccttctggactacgcagacaactaagataatcagtcctttcaggaagtactgtagagagccaaatgcagtggctcacgcctgtagtcccagctgctcggaggctgaggtgagaggatcacttaagcccgggagttgaaggttgcagtgagccatgattatgctactacactatagcctgggtgacagagtgagaccccgactctaaaaaaacaagaaagtactatagggctcctttttttttttaagaggcaaccagctgttaattagttgtcccctttttaaagagttttatatggaaattgtctaatttcagctcttctgcactggacacgggaaagaatctttatacctaataatagttagttccctaatccatgtgcttctggccttcttatactttccttctgaaaacttttctgagacttttatccaacatcatctttctggcaaaacaaccaggagatcaggggtccagagtgtactactcgaatatataatcttcccatttgatcattgagggttttagaatttaaaggtatttttgagtgattattaaataactttgtaaaactctgagtaccttgctgcctctatgttttttctctttaaacagtaaaatcaggataaaaatatttaaaacaggaccaagcttttgatatattcagccttttttctataattctgtcttgtgcagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtaagctaccgtgcacaaaggcaaaaggtacactgtgtctttctcagatattgaattatgctagtctaatgactgctctgaactgtcgacttatacaaacaaatttaaaatggttcagaaaatttttaatggttcaatccacttctgacttgatagagattaatggaaaacactcttaaaggttctgctatttctgagtggtgagatcgagtttgatttttcctttcttgtgttttctgcattctccatgttttcatttttgagtgtatttattgcttttttgtaatcttaaaaatgattaaagaaagttatataagcatagaaattaccccactcagtatagttggtaactgaggtctacaaagtggtttttgtaacaccgaccaccactcgtgtgtacgtggcctgaaacagtatttgtgaatagctgcatcattgcaataatcatacatgcgactatggacacgataaagttttagaaaatactatcaggcaaagctccttctatatagttttcccttcatatgcaacagaataagtggcatacctggtaaaaatggatccacatgtgtatctaatatggtttcaccctggagatcacagagaatcctcccgtcttcctcaaggaggggaagtagagttggctaagcaaggggaaggttcttttgcaggagaaacatgggaaccagattgagtgctttcaccctgtgaatgttgagatcatgcctacgaagaattgagacagatgccccaagctgtccttgttccattgggttttcatagatgcttaatatggctgcagaatcgactgtagtctgagcagaccccatcctgccgactcctttattagtttagcagtgccaagactctgtcctgctcagttatacatgcctcagcttcagcaccatcaccctacctctgtcctaggagtaaactcacatgggctgggcctgttggagtattgcctcagctgcatcggcttagttttgtcactcaatagagcccatctgttttgcaagcaaacagatgaatttgagactagtacatttacaaccaaaaggtgtgagttatctgtagctgtaacagtatagtcacagggcatgtttaatctcgggacaaaagctctgactcgggtaatttttttgctaggaaactccaaagcgtgttggtagataagaactataagaatgtgagatattgtcattattttctaagcccaagaattaatttcatcaccctttggaaactttaactttctttatattttatctctcctgggtagacattgaaaggattacagaagcttggcatcacccactttcctgtgaccccagggacagggttcttgagagaaccaagatctggggtcaaaaagtgtcacgttttccagccaggtgcagtggctgatgcctataatcccagcactttgggaggctgaggcagttggatcacctgaggtcaggagttcaagaccagcctggccaacatggtgaaaccccgtctctactaaaaatacaaaaattagctgggtgtggtggcacccacctatgatcccagctacttgagaggctgtggcatgagaatctcttgaaccggggaggcagaggccgcagtgaactgagatcatgccactgcactccagcctggacaacagagtaagactctgtctcaaaaaaagtataatgtttttacttgtttatgggtataagtttctaaaaattgagagagccattgatagtgaaaaactgtgctctagtaatcagcaagcttctcactcctcacctcacaaatgggattgacttccttcagaataggagaaggtgaatgtttgtctccaggggcatgtctttcagtcttccagcttcttcacaagaaccccacatctcttagctgcagtccatatcatgactgcagtagatggtgctgagaaatatcactaagggagcattggccacagatgttctcaaagtcattttcagctgagcgtggtggctcacgcctgtaatcccagcactttgagaggctgagacaggcggattccttgagcccaagagtttgagaccagcctgagcaacatggtcaaactgtgtctctacaaaaaatacaaaaactttaatggataagcagaggctgaaaaaaaaaaagtataaaaattagccaggtgtggtggtgctcacctgtggtcccagctacttgggaggctgaggtgggaggatcatttgaacccaggaagtggaggttgaagtgagccgtgattgtgccactgcactctagcctgggcaacagagagagactctgtctccaaaaaaaaaaaaaaaaaaaaagtttcatattttactctacattcagataaataacatttgccatttgtaaggcttttcattttgaatatttagttgtatttattatatactaggcatcattcttgttgctgttaaaaaaaaaaaaaaagagtatagtccttgcccatgaggagattattcattttctcaatgaaacatttgatgtgtaagcaaaatagaatttttatggtaaaaatggctttatattaagaaaattcttacattttaaaatcatatctggatttattcatttaatagatttcattgaacttttgttggcatgttctggcactgagtatacaacgttgaacaaaaatggagatgcttgcactcttaaagcattaacttgaagcctgataagtattagggagcagtatggatcaccaagatcctttaccaacaacacattatatgattaaatttgaagcagaagtaattattgttatagcactaaacagatcttgccatatctttatgatatgtattgtataccttagttgtagtctataaactctatagggtacttagagggagaggaactcagcctctttgcatagtacctcatttttgcttgctctctcttacatcccagtggtccccaaaggacagggaatgattggttggattctttcaagatcttcattgagtagtgtttgctagtaatccagattatcgtctgtcaacaaacactctagtactttctggttcattgtgtggggagacaaggagataaattgacttgggcccaggcattttgctcctgccttttgtcttgctccttgctttgtggggcacacagatgtcaggatgggcctaccaactcttctcccctaccacgggacaggattagctaaccaaaccagggcttttctcatgtcctggccaagttatgttctcagtactgttgccctggtttgtagaatagacttttctatgtgcatgtttgttgcgtttgatacattggtaagtcatgtactttattagctggtagtaaattaaaagttgcataacagaaaggtttgggtcattttccacttttacttactatataatatatgagcaattggttgttaaggaatagattttgagaccgtatttggtgcttaaaatttttctgccatgattatgaggtggctcagagaacagaggtaactcaataggagttacatctttgcattctttcctaggttttagtgccttctaagaccagatacctttgttccttttttataactctttcattgttcttggcctcttttggccttagctttctttgtaacacaataaagggattgcattaaatgatctctgaggtgccttcaagctcttaaacaaaagtctgtaatctcctgggagcttcagtcatttctgttttcctcttagattgtgtgggcttcagtctttgctttatttggagatggaagctactctatgttgtatttgcattttgcctacactgtattaacttaaactgaaactttgccaagctatatactgagttggtgactgagatgtttgccttaatgagggattattaatcttttgtttttccaaagctcttgtttcagttgtcttctttgtcatttggtctcaggtcttgatcgggggactgagtataatttccgagtggctgctctaacaatcaatggtacaggcccggcaactgactggctgtctgctgaaacttttgaaagtgacctagatggtaagaataacaattggcaagactggaacacaatagatactagctgtagtcaaatgagtcaaactggaaagccacagacttggggtggatatggctcaagtctgtgaactttagtgcatcacgctgctgttgttcctgtattgcatcgaggctgctggaatggattttttgcagtgccttgtagagaactgtcctttcaagcagaactagagcaaataaaaatgtgtatgtgctataagttggattttttttttaatcaaggccattaagtagatggatgatctaaaatttaaggctgagccacataaatcatgcctttatttcaactgcagtttcccttttcttttagtcctggacaccttgccctttttctcacatgtttattcagtgagtactcccaaatgggtgtgtataggtagcacctttatcagtgataggtgctggacttgggaggcaaaagacctgagttcttgttctgagtctcattttactaatttttttttttttttgaaaagggatctcacactgtcacccagtctggagtgcagtcatggttcactgcagcctcgacctcccatgcttaagcacgatcctcccacctcagcctcctgagcagctgggaccacgggtgtgtgccaacacacttagctatttttttttagagacagggtctcactatgttgcccaagctggtcttgaactcctgggctcaggtgattctttctccttggccttgcaaagtgctgggacaacagacatgagccaccatacctggcctcagtttactaatttttaaattaaggtagtaacttatgccctgaaaacagtgtatgtgaaagagcatgtaaatttcctcctttgtaagcctcttagtctctcaccaattgaatcaactgtggctccaaactttcatgttttctgacttaccatactacttaggggagtaaataattggtgctattgctataatgtgatgcttaaacacctgttaacaacaggcttcccactactcagtttatgcctttctcattccacctggtagagtttgggaatggatgtgggaccaagagagatggtaactattgaaaggcaatttatttttctccattggggcagaagaggttcttgtatctctttgttttctcttccaaattaatattgcagtgtcttgtatttaaagctgttcaggtcttttttttttttttttcttagaatgcagtaaaatcatgggctgtatttcactatacatacagattctttttgaactcttgggcataatgtaaaaaacttagccccaaacagtgtggtaggaagctaaacaccattccccaaggatggtgagatattttaaaggacagtatatctcatcttgcttttccacttttccttcccagaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctgggtatgtttgctaagtagagaaagttaattgtgtgggagattcctttctttttaaccttttatgtaatatttttatttttacaagaaaattgcgaaaatagtacaagtaatttctgcatgttattcacctgaattccccaaatgttaacatttaaccacatttacagctatattttgcagaatgcccctcaatttagacttggcttaatatttcttcattacattcaggttttgcatttttggaaggaatagggtagaagtgttgggtttctgtcagtgcatcatatcaggaggcacattacagcctatattgataatgatgttaactttaatcagttggctaaaacggtatctgccacattttcctgctataaaattgttatttttttccttggtaattaaaagtatcttgtggatgagatactttgagtctttataaacatcttgtttcccattacactttcactccctagtttcagcatctgtagtaacagttattagaatggtgtttccccagtggtgattttctaattccatatttcctctacacgtgttaacatcctgtgataaggaagaactttctttcacccctatgaagagaatggccaatgggaatctctttataactggttcctgtgtccatttgacatcttccatctttctttgagcactttcttcctttttgacaacatagtaagatgttcctggctcatctagtatttcactagcctcggccctggaaccagccatttctctaaggaaccctgatttattttatgaaaaatgattttggaaaccaatatctgggcactatatctattcattgtaactagggtagaaaatcctaaggaatctacaaaagggccacaagatacaaagtgaatatacaaaaacagtaaaatgattttggaaaccaatatctggtcactatatctgttcgttgtaactggggtagaaaatcctaaggaatctacaaaaaggtcactaaaactataagtgaatttagcaaggccacaagatacaaagtgaatatacaaaaacagttgtatctccatatactaataataagcagttggaaattggaattaaaataacaataccacgtagaatagcatcaaaaaatatgaagtacataggagcagacttataaaatgtgtgtaatatctgtgcactgaaaatagaaaattgttactgagagaaattaaagaatacttaagataccatgttcactggttggaagccgtgatattactaaggtgacaattctccccagtgcagtccaagaaaagtcacaataggcttttttgtagaaattgataagctgattctaataatttttatgaaaaatcaaaggaactagaatagacaatttttttaaagaataaaattagaagacccatactagctgatttcatgtcttcttataattgagacatagtggtggtattgtaaaggaagatgttatacatcaatggaacagaatagagtccagaaatagatccatatgtatatagtcagttggtttttagaaaagctgcttagataatttagtggggagaagacagtctttttaacaaaagttgtgggaatacctggatatccatatgagaaagaaaaggaactttaacccttgtcttacgctatatgcaaaaacagacctaaatgcaaatgacccaatgactttgggacaacaattctagaagaaagtgtaggaaaaaatctttatgactttgggataggcaaggacctcttaggttgtaaaacagcacaaatcataaaatttaaaaattgataaattggatttcatcaaaattttaaaacttctacttttagaaacataccaataaaatgaaaaggcaagccacagacttggagaaaatacccaccatttaaatatctgacaaagaatttgagtccaaaatatataaaaactcttacaactcaataataagaaggtaacccaataaaaagtgggcaggagatttgaacagacactataccaaagaaaatatatgagtggacaataaccatatgaaaagatgctcggcaacattaatcatcagaaaatgcaaattaaacccacaatgaaatgctattgcacacccgctagaattgctaaatgttagtagactggcaataacaaatatcaacaaggatacagaactggaatgctcatactagctggtaggaatgtttgacagtacaaccactttggaaaacagtttagaggtttcttgtaaagttataacccagtaatcccacacgtagataattaaaagaaataaaaatacatgtctgtgtaaaagcttatatacaatgttcatagtaactttatgaacaaggggaaataacaaattttcatcaacaggtaagtggtaaatcgtgatatatccatggagtactactcagcaattaataggctatcaagacacaacagaaattaatctcataaacatgctgaccaaagacgtcaaacactgttatattttgtgaattacaaaataggcagaatttatctatagtgacaaagcaagatcagtggttgcctggaaccaggggtgttaggaatcaactacaagggcaccagggagcttctcggagtattggaaatgttctatatcttgattttggtggttatgatgcaaggtatatatatttgtcaaaactgtaaatgtacagttaaatggatacattttattatatgctaattatacctcatagttgactttttttttttttttttttttgagacagcatctcactctgttgcccaggctggagggcagtggcgcgatctcagctcactgcaacctccacctcctgggttcaaatgattctcctgcctcaacctcctgagtagctgggattacaggcttgcgccaccatgcccagctaatttttgtatttttggtagagatggggtttcaccatgttgccccaggctggtctcaaactcctgacctcagatgatctacccacctcagccttccaaagtgctgggattacaggcgtgagccactgcacccggcctcattgttgattttaaaagcaaaagaatttgagaaatatttatattttataataaataatttattttgttaggtataattacttttccaaattggattatcgttatagatcttttttgaaacacttgtttctaaaattaaaatctgccctgaccaaattttcattcagatcgtttctttgtaaacatcttttctaagaacaacttcaagtgcctaacagaagagttatattcatcctttctgttaaaaaataagctgggatttaaatattcaaaaaaaaagtaacctttagctttttccttacaaggaagaaacagtacagttaacctaggaaatgtatcccccacgtgaacatcttttaagacaattgttagcaaaaggaaagctttgctggtagaataaaaatgtctggccaggcacagtggctcacacctctaatcccagcactttgggaggctaaggcaggaggatcgcttgagcccagacgttcaagaccaacttgggcaacatattgcgacctcatctctacaaaaaatttaaaaaattagctaggcatggtggtgtgtgcttctagtcccagctactcgggaggctgagataggaggatcgcttgatccctagaggtcaaggctgcagtgagtcctgattataccactgtactccagctgggtgacagagcaagactttgtctgaaaagaaaaaaaaaaaatgtccctgtagtgaccagcttcatactgtttcctttatgcaactactgatgtgaaactcctttgcagtattgacaggacatggtccttgatcttcaggtgctttcagtctaacagaacaaaaagaaaacacaagaaacagtgaagtgagttgaagtgaattttgttcagagaagggagaacgctatagcaagacacagtagagcagtcagggaagaaacccctgagcttgaaagatagaatcaaaatagcgtttgaaatagagagatgagaggagtgctgcatgtgcagaagagagtaagcagatagaatttattagaaaatggagtgcacattgcagagtagcaaaaaaattaatgcagcataaagtaaaataagcttgagctataattattgacctagatagatctaagatgcctatgatgttgagtaaaagaagcaagtgagaggtggagaaatgcagttagcaattcatctattcatcatcctggaactctcccctgaccttcagatccatataaacatctgcctactgggtatcagcacctggatatatctcatattccatctggcccaaaattaaagttaatgccttctccctcaaacctgttgatcaatcagcaaatatttaataaacacttacaatgtcccagacactgtgctagagatagagcagagaatgagacagacgttctcacaattattagaaataatacaattcaaaaataattgaaattgttcacggtgctgagggagagaaatgggctgtgtaactagagaggctagtccagtgtggaatgagccctttgagatgaataggcgcttacctaggtaaacaggaagagtgggatgtgaccccagcatagggagcagctgcaagcgagaaggccctgtgttggagagaacacagtgctcagtgaactgataagtggccggtaatgatggagcacagagaactaggcaaagagtggtgggagaagacaagtagtagattcaacaaaacttgattgtttgtctggaggggatgagggaaaaggaggtcttaataactcccaggtttctggcttgagcagcagggttggtggtagtgtcgtttactaaaccaggggacactggagccgatctgaagctggaggcagggtgggaagggaaagatttgagacacccaagaggaaatgccaaacagacaattgaacataaaggtctggtgctcataagaaagatccagactagagatctgtatttgtaattgatgacacatacatgctaatcaaagctaaggaaatgaatgaaagtgcatagggtgagagcgaagagtgggaatagaagaggacctagaatcaagccttgcacatgtgtattatggttgctcttgccccttttcccaatctcagtgaatgacactgctatctactgtgttgcccaaagcactttttccttgccagtcacgaagtaagtcttactgattccatttgttgttagttctgacacaggaagaccaggtgcctctatttgttgccctctagtggcaatctagggagtgggtgggccgccaagaaaagcagctgttttaagcttttgagccacatgaggcatggctcatgaggcatgatggctaggtgaggtttggccatttctggatttggaggccacttggagagtcaaggacattgagcacttaactgacttaacagtttatctccttcttctctaccttgtctgttcccatcgctgtccttccaggaatgaaaggggtttgtttaattccaagctccatctatagacttcagcacattaaatcttatctcttcattctcagccaagccctacaccataccctgaacatcactaaaccataggagagaccaagagagaattcaaacacagcccacctcctctactgagactaaatccgggaagttggtcccagccagtttttctgtactgtgtgtacttccatctccatatctccctacaacctgaaataatcccccataaaaatttttaaagttgtctttcttgaattcttctgtggttaagattatgcacagccacccttgaatttttaaaattctgtagtgagcatttttttaatgtgtgtttcttttttttcagatcccagctctcactatgtgattaccctgaaagcatttaataacgtgggtgaaggcatccccctgtatgagagtgctgtgaccaggcctcacacaggtaaggtatcctatctttcctagtctccagcacttttcctagcagcttaggcagaatattggcatgaggcctatcccataggtgttagggaagaaaaagcatatggcagtttcgggtgctgacttcaaatgggaaagtgggctttcagcatggaaagttctgttaatttgttttgcttttttttttggaagattctaattctgccacgtaagccattctgtgtagatatatacacgtttttaatctgttaggatgtggaaagcagagtttttagataattaaaagtgattttccgtcttttgggcatgtgagttgaaactaaagtgagtcaaaaacaaaaaatgtaggttactgacggtggcaataaatgcatgcgattcgtgaacccaacatcatttggttactagccacctgagttggttaggaaagtgtttttctatgtgccttttgtaagcttgagtataaggtcagaggtactatccatttgatcagttatacatttattacaaacgagaccaaatattcattgtttttctttgaattatctacttaaaatatctctaaaggccgggtgcagtggttcatgcctgtaatcccagcagtttgggaggccaaggcaggcagaccccgaggtcaggagatcgagaccatcctggctaacacagtgaaaccctatctctactaaaaatacaaaaaattagccaggcgtggtgctgggcgcctgtagtcccagcaactcggaaggctgaggaaggagaatggcatgaactcaggaagcagagcttgcaatgagccaagatcgtgccactgcactccaggctaggcgacagagagagattgtctcaaaaaacaaaacaaacaaaaatctctaaaataaagtaatatacatgtcatgtaaatttttctatagatatataagacatctaatttagatctgaaagagaaagtttattgaatatgttagagttataaattttttttcttttttttattatactttaagttttagggtacatgtgcacaacatgcaggtttgttacatatgtatacatgtgccatgttggtgtgctgcacccattaactcttcatttaacattaggtatatctcctaatgctatccctccccctccccccaccccacaacaggccctggtgtgtgatgttccccttcctgtgtccatgtgttctcattgttcagctcccacctatgagtgagaacatgcggtgtttggttttttgtccttgcgatagtttgctgagaatgatggtttccagcttcatccatgtccctacaaaggacatgaactcatcattttttatggctgcatagcattccatggtgtatatgtgccacattttcttaatccagtctatcattattggacatttgggttggttccaagtctttgcttagagttataaattttttaaaagggcactggaaaccaaagaatttattttcggaaatgttctttttcatttatttccaaaaattttgattctttattgtccagtgatatctgctggatatgttgcataattgtgcagatttggtaacattcttaaggaaggcttacctttcctgaaggaagagtacatccttgagttccttttgctttatttgggtgtgagctatgtcactctactgccattagacccagaacatcagggggcctaatattctctgtccttttttttaagcttctatttaagactactacatgtttggtagttctgttctgtcttctatatgcttacagtttataatttcttttagaaatagctttagtattacaaaaaggagcaaaaattaagtgaaaaagtatttaaataagtggtctgctactttctaaaatcaggctataatagtaaaaaacaaatttgacattacttccttttatgtggcttaaaaatatagcctactagctagaaatacacaagaaaatgttcctaagtcatgtaatctagatatgttttctaagggttgctacatataagaaaaaaaatttctacaagaattctaatgacttctacacctgaaggtgcattttctgtaactaattggtatgtgtcctgccaaactttgaacaaagctcttggttatataatgtatgctactcctctgttatttttagtcctcattgcacaggaaatacacaaatggagactattactttagcttagcaattattcataaacaaggtccatgccattccacattttgagtaataagggctagtcaccatgactatgtgagaaacccattgtaaactgtgaacttaaatcagtatgtgtaaacttagaaaacctaagcatgaattgggaaagcccgtatggattctgctgtattgccctgggcccatggtgcatggtgcttttgtgctcattctggcctcagagaaggtgtctgttgtatatggcacaggacagctccatgagtatagactttccatcaaataagtactgtacagtactctgatttctaaagtttgtgaagtttgttacttggaactgtgataaccatggcatttccgttaactgatgggaattcatcactgggttgttctctgactctgtggaagaaactatggtagatagtccagcatggtgtcagcttacctttcctgaaggaagagtacacccttgagttccttttgctttatttgggtgtcagctatgtcactgtactgccattagacccaggacatcaggaggtctgaacttgaccctttgtgggtatcagataccgtcaatacccatggctgacattcaagactcaggtttgagtgttggacccttacatgaatagtgatatgcacagataactcttgtcccaaaaattcagccacattcactgaaatctcaaaccatgaggtttgtattgcttgtttagaaattgtacccctgattctaaaagcagtttttgtcttcgtgagcctttttggttttggggtttttttgttttctgagacagagtcttgctctgtcacccaggctggagtacagtggtgcaatctcagctcaccgcagcctccatctcccagattcaagcgattctcatgcctcagcctcccgagtagctgggaccccaggcacctgccaccatgcccagctaatttttgtatttttagtagagacaggtttcaccatattggctaggctggtcttgaactcctgacctcaggtgatctgcccgcctctgcctcccatagtgctgggattacaggcatgagccactgcacctggcctcatgaggctttttgaacaggaagtagaattttcaagttattttaagaaaattcaagcacgaatacattaatataatcactggattataacattttaatatgcctatagaatgcagtagagaatatagtttattactgcttctcttaacatttttctgtaattttttcctgaaagaacacaagtggaaatagtcttttaaatgaatggtggttatctattaactctgaattttctttctttttctccatttctcacctttcattccattatattaccctgcatttcccttttattttatttttgtttacattaaaatgccacttccctttttaaattattttctgctcagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaaggtactgacacatttgccctggctgaaaaaagctaatcattgatactttctaattttaaagtctcaattcatgtttttttcagaatgcaaatgcaaccactttgagttatttggtgactggtttaaagccgaatacactctatgaattctctgtgatggtgaccaaaggtcgaagatcaagtacatggagtatgacagcccatgggaccacctttgaattaggtatgtgttgtcagaagccatgtcacatggctgcttttacttcccaaggaaagaattgagtgcctgaattgacatatttacaaaacacagtgagcaactacatttggaattcagtgtttgctatttcagctgacaagttgtgtgtttttaattactgaacaagaacattagcaaataacaggatactacagggaaaacatgataaattacaaagcactgggtagatgtaagggattattgccattaatcctgctttactggtaaactgagatagaaaagatgaagtgacctgcccttgaccaggcagttccaatgccatgcttgcttggagcctgaacactttgctgggtgaccccaaagctgcctctgcagtttgcttgcaagcaaattagcgtcttataaaatcttccactgaaataatccttaaggtctttgtaagtggacacgagagggaaaagatgactaagcaaattaaagagagaacaggctatctgggtttgagattctgtttggtttttgctgacttttagacatgcctttctgctaccccctgggctttcctagtctagggatatgcataaccatttcaaatctctgtctattttggcctcctatttctctcctatatgaataatggagttataaattctccacaaactgggcttggcctcagtgtctttttgtcttctgcacagttcactggactttgtacagagagaagggttggatttgaagagttagaaatacagtacatcaaagtttaaatagaccttgagtttgctttctttgccaaccattttaagaaaatgtttttacttcaatcctaacccattagataacaaatgagattgtgttttcccttaggatatttgcatttcaccaggcttccttacattttatactaagagaattctagtattttaggaagagttgagtaaatttaaggatgtacttaatttgctcattttcctactagtgtgttaaaagttttcagctatcacatggaaacacaggaaacgtattgtcctgttgcataaacgaacagcttcactttagagctgtaacctcaatagttggcagtatgtttgcagaataaactcatagtgaaaaatattaatctgtaaatcatctattctttgaagaaatagggcttttaaaagttatatttggggctgggagtggtggcttgcacctgtaatcccagtgctttgggaggccatggtgggcggatcacctgaggccaagagttcgagaccagcctggccaacatggcgaaaccccatctctactaaaaatacaaaaattagctggatgtggtggtgcgcacctgtaatcccagctactcggtaggctaaggcacgagaatcacttgaacccaggaggcagaggttgcaatgagcagagattgtgccactgcactccagcctgggtgacagagctagactccatctcaaaaaaaaaaaaaaaaaaacagctatatttggtttggagagccaactataaatgagagagaaaactgttttacaatttacagtattctaacaaaataatccagtgtgacagggaagaagtcatcttggacgaattacataacttctctaattttttggtgtcctgatccataaagcagagatagtgataactacctttcaaattttctacaaatactaagtgagatactatgtgtacgttacctggtatacggtaggtacttggtacaaatgccacttgactttcctacctaattatcctgtttatccctgactcccagccaagatgccaattctgtatcttcatagtatggtatttcctctttggtactctgaatattcttcttttgattggaacttttgatagacaaactgtgatttctttgaagccagaagctttatcttttttgccttgtgccctttattttgccttacaagtggaaaaggttgaagaaatagtgaactaatttgaaatggacagaaattattaaaaattttgttattttgtagttccgacttctccacccaaggatgtgactgttgtgagtaaagaggggaaacctaagaccataattgtgaattggcagcctccctccgaagccaatggcaaaattacaggtaaaatgcaatcaagtgtgcatttctttgtgcgctcttcctgcctgacaggagtattccaggagagtaccatgttgctgggagaagtgggagtctgaaggctggcttggtcattttatggtaaggtgtgagtcatgatggtccttgaaattggggtgaggctgtgctggtcgcccatagcggcataaaatgggttgcctgttggtggttctgactgcagtcggggatgggaggcactagacagcctttggctatagtgggactttgtagacatttattttccttaggaaagctgctcttctctgtctccgcctagatggacagcttcagaattatataccccctccctggttctgtagagtaatacccaataaacagagattctgctcttgtaccctgaagccacaaaaaaaaaaaaaaaaaaagcccattagatatttaattccttttcactgccccccgagacctgctacttcaagtacctgtgctcttataattagagttaaaagtgaacttgcctaggtctttgtagggacctggaattttttccttgtactttcagaggaaaaccttccacagtagaggggacactctgccttcctcagccttatcagggatggaagcctgatggggttcagctgctcttacttcctttggcgcctctggcccatgtaggtgtgtgctgaggaactggggtttgccctgaagttcctctgtatgaataggtggcctaaggaaatggaaagtgtttcttagcactgtcctgcttcttgctttcagtaggaatctctttctgtacatcctggtctttatgtcatttttttaggttttgactttgcctcttttgtgaaagaatgaatcatgacttgacttggattacattttactttgtcttttaaaaccggcaacagcgcagtgcccttttgctgtgggtcagatagattcatggttgtgatgcttcccttctcaatgtggggattaagtgccccctggtggaagtatcaggtgacagttcactgtggctctgcccaggagttcctaggagatcacatcggtaagagctaaaacagcctgtcaggcaattcctggttttcaaaactgaattattttaattgtagacccttgagggtacattattcaaatattatgctataatattcatatgatataataggtacttattgatttactgaaggcaaaaggaaaagcaggagtgagatttcttttcccattaattcctttggacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaaggtaatgctccccaagctgagggttttgttgtgtgtctctttagtggggctatgctgacactatcacttgagcatatagagtctgtggatagtatatgaagtcttaatgatgagcttgtgagccatgatgtgaagatttatcccagaatgattcctcacctactcattgaccaaatcagtgctccctgggttaccagcctaaacatatcatataaaagaggacactggttccaggctatttggggcagatcaattgcagtgatctaaaagtttttactggtcagatcagatatgattcttttggttcccatatagagaaagagtagtgtgttcttgtgatggatagttcaactcaggcaggctattaacctgaaagacttatttgtggacgttacagagaaaaagagactaaaaagagccttttaaataaaaccctagataagaaaatgaagataaagcactgaaccaagtaagcctagcctaataaaatttaactggggactgaatctaaggaattatggaagccctgtatgaatttaatttctgttagtactaaagtcaagtttcagtttgtttggaagtttgtgggggttttagtttttttcctttaaaaagttctgcctgtcccatcttcaaagcttgtgatccttgctcttgttttttcttcccctgtgcttggcctgttagcggactcctctgataaaatgcctaatgatcaaggtaaatgagtagatggcctctcttttctttcctttcttttgtgacctattattagcttttggtttttgtttcttttttttttttttttcctgaaaaatcagcaccatgtgttaaaagccacacagttattggccaaagtagagttgagtccatgttctgaaaagctggggaatttatgtagaagctaactaggctggcagaagaaaactgaaccagtaaactggtcctgcagctgtaggagattcgtcttaagtgtggatcagatcatcctttgtgctgagatattgaagttctgtgacaacgataagcatttaagtcatgattagaccgatcataccaattgttcatgtttgcagcagttgttcatatttgatcataccaattgtttatatttgtagcatctagaattttattagtgtctttaagtggaaagttgtatcacattcagtgaataccctattttcctcttcccacaaagaatccacaaatttaccttactcaatgttgtgattctgtgtgactaaattactgctttgtttattctgttaccataaacttaattcagagctcttttttcatttctccccttaaatatatctgatcatattaaaagaggatcaaaactatttgaaataaaaacttaggccacgtacggtggctcaggcctgtaatcccagcactttgggaggccaaggtgggaggatcacttgagcccaagagttcaagactagcctgggcaacaaagtgagaccccctctctacaaaaaataggaaaaaaaagttagctgggcatggtggtgcgcacctataatcccagctactccggaggctgaggtgggaggatggtttgagcctgggaggtggaggctgcagtgagtcgtgatcacaccactgcactcctgcctaggtgacagagtgagaccctgtctcaaaaaaaaagtaaataaataataataatagtgataattgaaatggggacctagcaaacaggggcctccatgtcaccattcttgaaaccatctgtcaatagtctttacactgtaactgccatggtggagggatagctatattttgtgatttttatctctaggaagtcagctaatgctagtatgttttccatactgagaatgaacattaaaagtaaatttaattattgctctcttggtttaagagtagttgttagaattgcaagttatttggatcttggctaatggcaaggaagagtcagaacttgaggtatcaagttttccagaacactttggaaatgtgtttgcattcagtgagtcttttgcactacattggagaaactgcaaacatactttctgttgtgtgaaagtgcaggaatataaaaatacccataatatatatatgcacagaatataaatgggctcattgttttctcacttgattccatagccagagtgcaattcttagctgcctgacacctctggtatttaaaattctttactcattgatatttttggtgctcagttcatccttggaatttcttgttcatagtttacattcaagagaaacaatgttgggaaatacaggaatataaaccatccagtttgttagcaatgtgtgttctttgacaattaggtacataatccaatgctctggatagtttggcttaaatgtagcctagctgtcaactaagtacacttaaacctgaagagccttgcaggtgctaagccatctccaccagctagactttgtcatagtgaaaagcatatgaggaacaactggactcttaatctatggtgtgtgtcacttgggagaaatgatggcatcagaagtaaggagataaagtaatatgtgtggacaatggaaaaagggccagggactgtgagtaaattctagaatatgcccttttggatatccaggaactcctgttaccttcttttggtaggttttcagtttctggaagcatagcattgttttagtcactggatttattctgttagatgaactgcatacacaaacttcagattttaatgttttcatttcattgaatatatgtatctcctgataatttatggaagtacttgacattagctctaatgttttgcagaaacacctagtttatacatttctagtaaggctttatttgtagaaataactctcatttataagtgttttttgaagcttcatgctctctgcctctttaaagagaagattatactctttcgtgaagattttttatgcttgtaataggagtggttaacatttatggaacatctactatgtgtcagtcagtattaaaaatattttatggtattaaatttccatttaatcctcacaacagctttgtgaagtggataccattattatccctgtgttacaatgagaaaactgaggcccaaaaagaataaataacttgcccaaagtcaaacagttgtatatgatggaggtaatatgcaagtgcagtctgtctattaaacaatgtgctatattaacctcatagttaacttcataaaacagcttttactttgcaattctttcagacctctttttcaggagaagtatgatattgctttctgggtataaaccttagattgacacctttgctttattggaaaaaggtcctcgtatttgcttttcccaagcagcttttcctataaatgtgaagagcaaaattcaaggccaagtataagaattttttaaaaaactgatatttgcactttctgaggcctccttctggggtggtcctaggcctgaggtcagcagcctcacttagtatgttccctgatgatggattaggagacagtgtctttttgagcaactaggaggaagactgtttttttcagcctctggaatgtttaggtgactgagcaggaactgagaacctgatttgaacttccatttaccttcctgctcctgcttagcttagggtaactttatattcagaaggacaactttgtaatttgagaaaagaatctaaacaatactaacacctgctaggtcaggtattagtatccacatagccaggtcccttggaagagtatagttctttaatgtagacattaacctaattagtccccttggttgcttttctaggagaagctacttttgctgtaagtcctctgagcagtcctttgggaactgtttcctaagctagagaaatagcacctactgtcccagcttctaaacagcagtgacagtcagctcacagccgtgagacaagcgtgtcagtctttcagatgcctcattacatagaaagctataccttagtttgctttccacacatagactatagattcccatgatttatgtgctactttattttctcatggacagaatagactaaaaattgtgttttttgtttaaaacactccctagctatgaagtggactgtcacgccaaatgtgtggggtcattattgacatgatttcttctcctttagcctcagggtctggagggaaaggaagccggctgccagacctaggatccgactacaaacctccaatgagcggtaaagcctttcccatggcgttttttgcttactatggacatgaagcacttttgcttaaatttttgaaatgtcctttatagcttgtgtgtggtgggttgtagcatattagcctgttttcttttattgctagatttaagtgtttgccaaatcactccaagcccatgtgtcgtaggacccataaatcaaattgtttccccagttatccaacttaagattaattcctaaacaatttgttcatcctgttgcctactgcctctagaaaagagttagagtttcgctttcaaaaataaaccctctagtgggattagccaccatccaaaccaagccaaacaaatgcttttagaatcattaagttcttccagtgctactacatactgcagtgtttttagtttagcaattctagaaaattcttccactctcctagccatcctgagagctggtgccttctaatttaatgatgacacccccgtctttacagagcttcaccatatataagctactttcacacatgaagtcacaattgattcttacaacatggtgaagcagggagaacagataccgttattcccgtttaatacattcagaaactaagtggagaagtaacgtgcctggggccacgtgctaattgtggcagtcctaggaccaaaacccagggcttctcatttctgattgtgcttttcccactgtcacattcagcctaaaaaagcagtgggtgctgtaccagacgtgggaacctagagtggaaagtgtccacagaagtagttactaggaatgacccttactgtctcttcacatgtggaagagagagacatatgagagaaacgcctgtcccctagtaactcatagtctaattgtaggaatacgatgatgtcttaatctccagctatctatttaaatcaaaagtggaactgcccagactttaatgaaatcagccttaaaagaaccagacaaacttaacatccttccagaaataattgtgctccaggttctaggactctgtttatgagtttcttcttctccatgtgtatgtgacatttatattgtgtccacagtataatttttaaggctgtgaggaaggtaattactcctttgtctttctttcattcatgtattcactcatgcatgcatgtttttttgttgttttggttttggtttttttttttttttgagatggaatctcgctctgtcacccaggctggagtgcagtggcatgatctcagttcactgcagcctccacctcccgggttcaagggagtctcctgcctcagcctctcgagtagctgggattacaagcgcctgccaccacgcccagctaatttttgtgtttttagtagagacggggtttcaccatgttggccagactagtcttgatctcctgatctcaggtgatccgcccacctcggcctcccaaagtgctgggattacaggcgtgagccaccacgcccggggcccgcgtgcacgtttttaaagatgcaggctctatgtgacaagctgtgggagcaagaggagttaataacaaactacctgataaagggaaagcttcctagaagaggtgccgtctaacccggatcttcaaggatgctagaagattgctaaatgtcaagaaagggattggacattccaggaagcaatatcagcatgtgcagaggcatggcaatatattaataaaacagcctgctctctccaggagtcacactgcatagagaaaggatagagattgagttgaaaatgcaggttggaatcagcctgtcaaaaactcaagtaccagtgctaagaaatatgagctttatcctacaaataacatgtgaaatatctgacaccactggtacactatgacatccatcttttattatcaactgttattactctgatagcagtgaagaataagttgggggctaagagtataaagtcaggcaagaggggttagggagctgttacaggccaggcgtggtggtatgcacgtgtaatcccagctactcagaaggctgaagcagaagaatcacttgaacccgggaggcagaggttgcagtgagccgaggtcacaccactgcactccagcctgggcagcagagtgaggttccgtctcaaaaaaaaaaaaaggaagctgttatagtagtccagatgaggcataaagaaatggcatatatattgtccctggtaggactgttctttggcagctcactcttgctgtatcttagaagaaaacttttgtccagctcattcgcaagaggtcagatgcgagtaaatgagaatttgtcagtgaaatgcaggaaagaaccacctccacctctgcctgcctcccatacttcagctccccagcctctaatttgcaatgcctgccctgccaagtacccaaccctgtagttcagcactgctattaataacagtgttatggaaagccctactctaatatgaacagtatggtccattttagtggccccagtaccatggtctttcccaaatataaaaacattattttattgaaggtcagtatgtacagtttaagttgtctgtctgcttacctttttctcataaatgaaagataaaaatgattgaaccaaatgtagaataggctcttaatcccttctaaatcagccccagatttagcactgtacttagatgtagtctgtaaaatcaaagaagcaaagttggagggtcagttaatccggcgttgtggaagggattcccacaatgagtgtaagtttggattagaacataaatttgggccgggcgcagtggctcatgcctgtaatcccagcactttgggaggctgaggtaggcagatcacgaggtcaggagatcgagaccatcctggcaaacactgtgaaaccccgtctctactaaaaatacaaaaaaaaattagccgggcatggtggcgggcgcctgtagtcccagctactcgggaggctaaggcaggagaatggcatgaaccagaggggcggagcttgcagtgagcggagattgtgccactgtactccagcctggacgacagagcgagactcaaaaaaaaaaaaaacacataaatttataagccaggttgttaggagaaccacttcaggagattttttcccccctagacggagtcttgctctgtcgcccaggctggagtgcatggcgcgatctccgctcactgcaagctccgcctcccaggttcgcgccattctgctgcctcagcctcctgagtagctgggactacaggcaccgccaccatgcccggctaatttttttgaattttttattagagacgaggtttcaccatgttagccaggatggtctcgatctcctgacctcgtgatccacccgcctcggcctcccaaagtgctgggattaacaggcgtgagccactgcgccaagccaagagatttttttttaaaacacacattccaggccatactttgatggtaggaacttcttccacaacatcccacgctggcaggatgcctcttaagtacttccaataactaaagatgcatttcttggcaaggcagctcatcccattattgtacacctctgattgttagaaaattaagagagagagtagctagaaggaaagagattagatatccatggtggttagacatgtgtggtgggatttgccacattttataatatgagcatacataaataatgagtagggaggcaaagaaacatgtttcaagaaatggaagacagtaagacttagagctaaattacaaagcctagagctcatcctttcagcaatggggaaataataataggaaaaggaaaagaaaatctgaatttccttcttcagggtcctaaatggtccagcctctgcagcttttccagccttatcccttttttcctcctcacttccttccttctgacttgcatctctctgcttaaacaacactggctgcatttctcttccttgagaagagcttgttcctgcctcagggtcctttcccttgtatgatggaatctttcttactcagatctgaactcaaatgccatcttctcagagaagctttttctaaccattcaatctaaattggctacccagacactctgtatcataacccctcattttctttttttcacaccgttagttattaactaataatttcatatttatcgtttatcccattcccccgccaaacgttcacatctttgttgttcaccattgcaccttagtacctagaacaatgactgacacatagtaaccattcagtatttgtcaaattaagccatacttcagacctactgtttcttgaagttgaacaagagaattaactctgcgtaggctgtgtatttataaaaacagactttacttttcatgcaatttttataatctcagatatctgcctgttggggaaaacttctgctttgtatgaatgaacatttttaaatggttttgaaaaccagaaaactaaatgacttataagtggtgctttacaaaatgagtttatatatcacatgagacaccagagagccaagactctttatctgtctaagtatatctcaacctttgaaagctcttgaatgttcagtacaatttgagaagctttaattaagtactatctttgagcaggctctgtcctgagcactgttcataggacagactcttagctgtctaggagctcatcatctagagaagagagccatgttcacgcggcacttttatataagtcagagcaatgagtgttatcaagaagttcacgtgagatattaatggttctgtagcttgatagtatgcatgttttaaattctctaaccctaacacatgtaccatttctctctctgcaggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagtaagaagccccagatgcaccccttagatttttggcatcttatcttttgcttccatgtgacttctgtatatggagtggtacacaaagttaagacataaaaatacatgaaaaggaatttaagatattttaaaagaaaatgggaagtggttcctcttatcagtcagtgtcctggcagaaaagagctggcacatttaaaaggatttcaaaagaggtaatttacaaagtcataggtggggttagggcaaactaggcagggatattcagaggctagcagctatgataagacaccatcatccttgggcctgaaagggcaagaggagagagctgttttcagaaatctgaagcagtaggagagggcttcctgacaaaagcaaagtgggtgctagaggcatgcagccattgccagcctcctcccagcgggcagtggcaggaaaagaaacacctcctaccctccagcctcttgccagtgtctagtattagctatacccagctggaagccaggaaacccagcaggattgccaagtaatagttaatttagctcaacctctggggtcagagggccaactagagaatagatgtggtgagaaaagtagaaagtgtctggcattgctggtcaccccctttggagcaccatctgtacatgcccacagtgaacccgatgcccaggagtctgtggacattcttacaggctgtgtcacagcacaaatgccagcccagttggaagaagaccataggcctgtcattctaaatctaagtttaagaatatttttaaagaattgctaccaagtgtagagttgggggtgggggtaggattgctttaatgaacaggaaaggatcattgataatcaatttatcagtttctcagagcggctgaatggctgctagccttgaactcctctgggattttgagggttgtggctaatggtctaagtgcagatagcaagggggctcagttatgtagtgcttgctaataccatacagtcctacacttgaaagaatccttgatcctaaattacattcaactcagatatctggttagcaaaatagatagaaaaaaaaaaggagattcctgagttattcctaatagcagtaccataatgtgcataataaaatgactttagttgcaatatcttgaaagatcataagatgggggtgttgctccgctagagaaagagaaattcatgtttatgtgattatccatgcagacttgatctgcccaaggcaagaatgcatgtatttaataatcataaatttgttcattttcactgtacagggtaagtacaggccaccctgtaactgctactggtaatgactttatgtcattttttgtaagttatgtgatattttaaatctctctttcttttgcccaaatgaaatagctttccatagcttgtactgtatcacttttccaagaaaaatggaggcttcttttataatccttctgaccactgcctcttatagctcttcctttttttttttttttttttcttttgagacggtgtctctctctgttgcccaggctggaatgcagtggcacattcttggctcactgcaacctctgcctcctggattcaagcgattctcctgcctcaggctcccaagtagctgggattacaggcacccaccaccatgcctggctaatttttgtattttttaagtagagatggggtttcaccatgttggccaggctggtctcgaattcccgacctcaaatgatccgcccgcctcggcttcccaaagtgctgggattagaggcatgagccactgcgcccggccctgtctacttttaatagtggaaaactattatttttaaagcctcaaagactacatttttttttctactctagaacttttcttcaagcctctttatttggcatttaatatttatctatctatgaacttgattttatatcagttttagaaatattgggatctttatttttctgttattgaaataatttgaaaaccaaaatgacagaattccttagtgctttggaagacttcaaattcaaagtaaatttttttttagacaggattttggtctgtcacccaggctgaagtgcagtggaacaatctcatctcactgcaacctccacctcccgggttcaagtgattctcctgcctcagcctcccaagtagctgggattacaggcatgtgccaccatgcccggctaatttttgtatttttagtagagacagggtttcaccatgttggccaggctggtgtcaaactcctgacctcaagtgatctgcccacctcagcctgccaaataaggtactcagtcttcagattgaaagtaagaagatgagttgataataggctctattctctgtattggcacgtcctacagatttgggtccctttgttgaaaatcatcatatcagatcttcatggggttttcccctcccccacttccccagttatctgctttgcaagtattccattgactgttgaaaaatataagcgagcttttcttactacttttcttcctacttttcttcctctgtaatacctgaggttcatttagatggtagctgtttacagagtcttacaacctcaaagttgatagagcatttagagaatctaaaccctcgttggttctcagcacattcccccttagcccctgactggcaacaggtaagctgggcttctccttcatgaagaaggcagaagctgtcagataagaacaacctcagcacaccaccatcaaatctgacacctttctacactggtaatcatcgtttcctcctccctcctaagtgtacttcccctgtttgaagcccgttctaccctttaccccctgaatctcattgtcttccatttttctaagaccttttacctgctgttattcctctctccagcatagctgacctcttactcgttattggccgcctcttcagtatttaagtgtgctctaacttcttccagcttaaggaataattataattataacctcacccccacccccaccccctgtatggtccttttcaccggctgcttactaacctttcttctccaccacagaattccttgataacttgcttatactcttatgtctgttcactgcctacccatgcatcagccctttctaatctttattctgcccctaccacttcaccagaattgcttttgtggaggtcaccagcgacctgtgtattgctaaagccaaagaacatttttcagttctcatcttagtctctcagcaacatttcacacagtcaaccattccttccttctggaaacattttcttcttttgtatccatgacagcatgttttgttttgttttttgttttttttcataggtcctcctgtctacctagccatcaaatacagacattcctcagggcctgggcctggacttactctcttctccttctgtgttctccccaagtgatctcatctgctcccgtggcttcagcattccagctacttttgtatttctgtctccagccaaggcctccctcctctgagtatcagacttgcacacacagttgcctcttctacatttcctcttgaatgtctcagagacatttcaaattcagcatgtccagagcagaattcatcatcttttcaggcaaacccgcttctgctcctttattcccaatattaagtggcttaaatcagaaaccttagcatcatcctgtactcctctttcttctttactcccacctcaccctacatccatttatttaccaagacctgtcatgtctgcctcctgaataactttcaaatctgcctcttgcctctactcccactgtcccatgccatcagttatggctgagattgcagtagcatcctagctggtctcctcttctatccccaaccccacagagctattcttcacatcacagctggtataaagttttaactcaaaagtgttctccttactctcttgcttaaaaccatttaatggtttctcattactcacaaagggaagttcacactcttagcattgccctaaaagctctttatgatctggtccctgactacctttctagtattatttcacatcattctctgcagggttcactatgtccccaccactcaggatttcttaaaatccttctaatataccaccagggcattgcactctgctttagggttttgacataagctgatttcaccacctggaatgcactttctgttccctttaggtcttagcttaaatgtcacttcctcctctaggtttttcctgttcagcttaagtccaactgttaagaagttactctaacacttgacatttcagtaagctcagaacattttaaaataatagttcaacgtctgtattcctcactttatcaaaaattctgagggcacagcagtctagcacagggtctggcatatactgggtacccagtatgtcctcattaggggtaagtaagagagtgaatggagaagctaaaacacagagaagtagacattgttgtccccattcttgactccacctagttggtagtcctagtttggcagtcttcgaagttgttccggccaggtacagtggctcacgcctgtaatcccagcactttgggaggccaaggcggcagatcacctgagttcaggaattcgagaacagcctggccaacatggtgaaaccctgtctctactaaaaacacaaaaattagctgggtgtggtggtggacgcctgtaatcccagctactcaggaagctgaggcaggagaatctcttgaacccaggaggccaggttgcaatgagccgatatctcgccattacactgtagcttgggcgacgagcaaaactccatctcaaaaaaaaaaaacaaaaaaagtttttgcctccctcctttataagccacagactttccctctactccattgttatgtttctacattgctctaattagaaacttgtggatgaaccttctggttatgagattatataatgaaaaatgctatcttaatcttttaacagtcaaaaaaagtagtcacaaggcaggattcaaacataaagaccctggtaagtatctctaaatatgtgtggacaaaatagagatacatttactctccccaggagcaaacttgttgttgttgttgttgttgttgggggcaggaggtatgtttttagtttttgctttttttgcttgaaacatctctcagaaaggaagttttaatcactcaagccttttgacaaatacgttcaaatgagttactttttaaaagctcctctgaacttcgtgcctaggaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagaggtaccattttaagtgcaggttttttctcaaatgttaggaaactattttcatttaaatctttttttttttccctgagtttgccttcatttggcaattcctatatgagatcagatttagagaaatgtgtatgataagatttgggaacatatgatgaagaatacctagcttcttatgggagagagattctgtagccatacgagacaatcttgcagatcttttaggtctctcatcaggcttcagcagcgtgatattcaaggatttgaggctagctagcccatgtctgtgcatttcattctgtgtcttcagctggcttccagcttgcattgtggtattcagaacattcttggtctggaggctcttatagacaccctgtgaagtatggtgggcagcattgtgacatccacattgattcagcaggaactcttgtaatgctctaatgatcattttcctctttatttcacttcttacagaaatgtcttgtccccattatgctgtttgtgaattctgaatcccctactagaaatgtttcactgttgaggctgctcagtggcatagggcacatgctggtaactaacctccacgtttaacatctagggcatgagtcagaggacagcatgtctacactggctggaaggcgaggaatgagaccaaaaatgatgatgccctttgactcccagccaccccagcgtaagtagaagcatctcttttcctcagtgctaccaatctgttcagtcatgtaggggaacaactatgaatgatctttttgacttcacttgattctaacacaaagataatctaccaaagctttgacaccttgaaggaggaagtaccaaacacttgccatattttgcaacaaacattattcttgaggctagcgtcgttatgtttatggtaaataagctgaaaagccaatgtctccagattcccaggaataggggagtaactagtctccctaaaagtgcatcatatctctatgggagagatgggaaagcttccctcctccagactagagctaaggatggtctgatgttacaagttttcattacgctgcctgacaccagtgctgatgagcacctgtgaaatttatttttttaattaatagatttgaaggccaagcaagatggcccacacctataatcctagagttttgggagaccaaagtgggaggattgctggaggccaggagttctagaccagcctgggcaatgtagtgggaccccatctctaccaaaaaaaataaaattaaaaattagccaggtatggtggtacatgtctataatcccagctactcaggtggctgaggcatgagaatcacttgaacctgggaagcagaggttgcagtgagccaaaatcgtgctgttgcactccagcctgggtgacagagtgagactctgtctcaaaaaaaataaaaaaaataaagccaggcatcgtggcacacaacctgtagtcccagctacccaagaggctgaggctacccaggaggctgagatggaaggattacttgaacccagcgtttaaggttgcattgagctatgattttgcaccattgcactccagcttgggcaacagagccaagagccagtctctaaattaattaattaaaataataaaatttaaaaataaaattagtagactttatattttagaatagctttaggttttactgtgtggaattttttttttttttttttttttttttttgagacagagtcagagtcttgctgtgtcgccaaggctggagtgcagtgtcacgatctcagctcactgcagcctccacctcccgggttcaagcaattctcctgcctcggcctcccaagcagctgggattacaggtgctcgccaccacacctggctagttttttgtagacacggggtttcaccatattggccaggctggtctcaaactcctgacctcagatgatccacccaactcggcctcccaaagtgctgggattacaggcctgagccaccaccacccgcccagccggaattttttaaacaacatttttcattcttgattcgtgcctcactttgataagcataaaggtttctgagcctcttttaataatagttgaaattcaaaataaatatcatgattaaaccagaaagcagtgggacaaaccgattctttcaaactactatgtcctctctcgtcactgttttcaaggaagtgaagcctttcagactagctagcacagtggggcttgcagttgagggaattctcagccatctgtcaacaaacgatgcgatttaatagccatgaatatcatacatgcaacgaggtacaccatgacatcgtgcacttggaaaagttcctcaaatccccaacctcttggtggaagcttcaagcacgtggatgtctgcacacgcattccctctcccacaaacactgtacacaaacatgtaagatactggattacaaaaaccatctttgaaagagtaataccctatttgttaacaggtaatttcagctcaaagtagcttatgcttgtggtccttgatggaaagaaaagcctggacttggaaatgcaggggaaaaccatggtttccctcttacaagaggtgccctggatggggttcccaggtttaaagatacaaatgcccaagaagagtaaattaatccatcccagttgcttctgattgatcaagaagatgctagcactatactcttatttgtttgttttgtataagacttgagttcctacctgaactggcttattttgaaaacttgtaaaattttactatctttatttctagatgtattacttttaaatatgttaagtaaaaaagatatgttgtccagttgatatcattcttctttttttgatgttggggaaggagtttgcaccaatatacaatattatttaatttgtgccttaacagttgggtgggtaagtggaatcttttaaaaacctgcaaccataagatccacttgtggtctttaggttttcagatactgtttttaaaacccgcatggctacagttctgtttcacaagctggtattccctgagctctgggccctggaatgctgcaggagccatatacccactccccaccttccctggtcttaaatgactgagcagtgccaggaagggtttgctggtgctgggacatggctccatccagggccatgcactgaagcaacaagttcagagtcagctaacagctgctgatttcctactatatcctaggcaggcacattcacactgctttatttttttttatttacttacctagaaagactggaaatgccttataaaagggaaaaagtcaattttgtttttcccttgtgagagtcctaaaatgctttcaaattgtactttcctaggtaaaaatcaggtttattccccctaccccagcctgaattctggaaaacactgagtctgaagcacctacttctaaaaactacctgtcttcccctagagttgctgactccccagttacctcaagagccctcctcagacagctttcctctgttgttttattcccgggcacaacctggagcctctggtccccaagagcagcacctgagggaaagccccttttttgttcctcaggccttgagaagggaaggaagggtcagcagtgctcaagggtcccagtcatgccacctgcttgcttgcatgtggccaggacaagggatagctggaaagtaaaggcacccattttgttgaccaggatttcttttcaccagagtaatgttgaatagccccacaaagactttagggagatccttggggacagaagacatttcaataggccactaagtgttaattaagtagtattattaagttcatgaagcctttgtttggagaaaaaaagattcccagtattgttagtcagctttggcctatttgcctgtttggtgggggtagagctggttatcttgatcttaaacgtgccatttctacaaccactccaagggagttcctcagaaaagtttattctcagactctgggcttctaattttatctgtttccatctcagatggataatgaagcctcatagaaagtagtacatggaatctctgtcttcatagaaagtagtatgtgaaatctgtgtggaaatttcagattctttagctaaacgcagttaattgaatccttagccagtgtgggaaggaaagagccatttattctcttacatgcagatgggtatgtctgagtccccagactggaagcagtaaaagatggtgccatcagccagtggttcatgcttttagtactagatgggaccatcagagttcaattccatttgcatttattttaagacatgaaagccgattaaacagctacttatttatttggcctaaatacccattaaatgcttcattcagcagttttaacaaaggcagaatgaattaggaatgtactcgaaaaagaagggacttctttctatccttttagcaggacaaaatagaaaatttatgtgttggcttatggatttatattttgtgacatattcaaatagatacttgtaataactcatgtaatccatgtttattatagtagaattggaaaatacagataagccaaaagaaaaatattattttaatcctgaccactcttccctgcaagataataactgttaacattttagtgtatattcctttttttctatatatatgtagacatatgcaaaagagtatcttcatttttaaaaaacaacgtaaaaatcaatggctaattgaccagatctagccagctgccaccaaaaaaccaagggagtgtttggattgtatgggaggtgggaagggggtgactttgctcttaaactgtgatttgtgtgtgtttgtgcaagcatgttaagcatttctctgtcttgtgttcattcacagctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacaggtgagagatgaggatcaagcccagatggaaaccattccaaaagagtcggcaagcagaaatggggaaggacttgccctacttagaagagggatttggaatttttctgttttatttaacttagcataacatttctgtgactgactcaaatttgtttctgtaaaattcaccccatatttctacttaagttttaaacattcagtgcaaggttttcttttagtaaaaacagtatctctaatcacataagcatcccttgttccataaacttgcactttaactcagtcttttttccaatttctttcttttaatcctctagtttgaaaggaaaactcatcctgggtgatttcagacactagtggttgcctttgcctggcagtcactgtaacattgggtaggtccaaaggttaactgttacatacaggttacttccaccgtggaccaaagtgcaaacaacatccaaggagcagtggggccaccagccacgaggagttgtgtgtattgtaaaccacagggtgcctgatgtaaacctcaggattattaaaattaggaagcgatgcacaggaatagatcctctctgaagaaacagaaaattacctctgaagtgtatttaaagaaatacgttgctagacaaacatgtccccagtttggaaatcttaggaaaccgcattatcaaacagttttaaggaggaaagaaatagtgaaggtgtgaggacagtaagcggcataaatattcttcattaattgaaaattaattttcatcctcagttttaaacggcaagcctagtaacttcccatatattcaacatattatttttccaccatttgaaacttgcctattaatagttattatgttactgatagaactgagttttgctggtctggggaataagggaatttcaagtgagttccattttaaaagaacctcaaaactttatgctggaaatttgggtttccagtaatatccccattcttttaagttttttgtttttctttggtttctttgtttgtttttgagacagagcctcagtctgttgcccaggctggagtgcagtggtgcgatctcggctcactgtaacctccacctcctgggttcaagcgattctcctgcctcagcctcccaagtagctgggattacaggcacacaccaccacacccagctgatttttgtattcttagtagagacagggtttccccatgttggccaggctggtctcaaactcctgacctcaagtgatccgcctgcattggcctcccaaagtgctgaaattacaggcgtgagctaccgcgcccggtccccattctttcaagttttcatcaatcataaacatacccaaaacatcaaatgaagctttattaaggggtgcctaataatttccaacattagctactcccaaagctattacctgatttggagaatgctgcttgaactcacatctaaatttggccttccaggctgagcagtgtggctcatgcctgtaattctagcactttgggtggctgaggcaggaggatcgcttgagcccatgagtttgtgaccagcctgggcaacaaggcaagatcccgtctctactaaatattaaatatatatatatatatatgtaaaaatttggcctttctactatctccctccaaatcccaatttggagttctgcatttaggaaagacggtttccaagatggacagttactccagccagctgcatggagagccaaagtctgccttacagacatagtctcaaatagaacagaggaccagaaagcagcctccacacctgctcttagaaaggaggttttgtgcccaaccctgtttctccatctttaaggccaaggaatctcacatgctaggatgtggtcctgcctgagtggatggcaggcaccttccaatcaaatcagccccttcctccttcctcctgggtttggggattggagagaagcatggcagctcctacccagccctctcccttgtgatctagtattggtaagcattccctgctctacggacctaggcagaaagtgaagagagggggaaagaataatttgcattactgagagaggccatgctttgatgactagttggataatagaaggtaaaactaaagtgatagacttactgaagactgatttgaaatatagagcaagtatccagaaatgatcaaagttctttttcacgattgtactttgctaagctcctgtgtctctggagctcagagtgttgccacagcttggtatatatgggctaagcagggccagtctctgctctaaggagcattcactatgtcaccaccacttgacattggaaaagcactttcctcttgtccaatcacttggccagtgtgaactctgtgtgtcttaactctttaagaggcaagtcagtcaggaagtagcccccttgccaaagcaggaattttacttacagcatggattctaagcaggccagtgattttgcacactgtcagggagcacccttcatgataaaagcaacgtgcctggggcccccggagttgtgcaaggcagccctggtctgtggtagcaggcctgggtgctgactcatgtaggcaaccccattttcctttttcaccttttgcgccatctctttggccctcagaagcttatatatccagttacagaccgttgaggcagtcaggagaggccggtttgcccagagctgacctaacatatctgtcagtacaggctgacatggcctggacatgagtctactgttctctctcctcctccctgctacccttcctagccagctcctaccctgcccagcttctccctggcccaggatcacagagggggaccaccagctcccccgccgtggggatggctagcttgagcaagcctaagaagatcctcagcacacccctttaaggggtgaggagtgacctaagcctggtagggccaacatagttaggcacacttgggagggtgtacgagtccctcatccatggacccaagatcagaggtgccactcgtgactggtgtggcctgacttctcagagcccaagggcacagattcactgctacttcagcaacaaaggcagggaaatgtgttggatttctgcagattgctcatgctttacagtatccccatctgcggggatacattccaagaccctccccctccccccgcagtggaggcctgaagtcgcatatagtactgaaccctttatatctgttttctccatctgataaccgagacagctactaagtgactcaagggcaggtagtgtacgcagtctggataggctggactaagggatgaggcacatccccagtggaatggcgtaagatttcatcatgctactcagaacggtgcaaaatgtaaaacttatgaattatttatttctggaatttttcatttaaatttttggacagcagttggccacagataattgaaatcattgaaagcaaaagcatggataagggggactactgtacttgttaaggttgaggactccagaagtcagaagaggccttcaggccacctggtacagtccattgccctgagctgtgtccccatccctctcctcacaggtggggaagctggtcaccagctcatgctgttggaagggtcttccttatgtggtctccccgggccttggtgctgcttctgccccacagggtgggggcaagtggtagtctgggtgtggaaaggtgtgtggtggtccagagcatgtgtgtggaagtcggaaggcagggattcagattccaccctgctagttcttaactgtgcaaatgggcaatttgcttaacctcccagtgccttctgagttactttgaggatctagtgaactaatgaatgtaaagcagctggcatagtgcttggcttaaagtaagcacccagtaatttacaaagaaaagaatcttaatagatagatattcaagcaccgtgttcagcacttttcatacatctcattcaatcctcaaagaattatgtgttattctccctcttttgtagatgaagaaactgagactcagagatattcagtgactttgtcaaattcacccagctagtacacaaagattggagtccaggtctgtctgactccagagtccgtgcttttctaccctgctgtgctgccttccagaacaactctgccccttcttatattttgagattgttatcatgttcttcctgagccttcccttctccaggctaatctacccccatttccttctctgaatcaaaaatgcccttcatttggtgtgatctgaaagctgtgtgcagacctctgggctgctctgtttgttgtccaattctcacttgagctatgggttttttgctgtgatgaggccatgcacagtccctggaggcacgaaggcctgtggcattggcctctcctgcagtgaccgccaggccttgtcagcagagctggctactgtcaggtacccggccagccttggtggttagccatggttgtctatgaaaggccactgtctaagattccagtgagtgaagtttttaattttcttttatacttatttatatcttaatatcttagtcatctcaggaacctttacaagtgcttcataataaataatgaggagaactttaaatctacaaaattgtgaccacttagctgtgaggtgaaaaactggaatagctggttgagtacaaaattgttcgagactccattcttatccctggcagtggtgctaatccatgttctcttggactagcactgatcgcaagtgctattgagctggtttagggaacccctagaagtagccaaactgtgggactgtcacatatttaatggcaaaagaaatgctaacatttagactttcctgctgtagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcgtagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgcccagacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtatctatcatgttaagataagtagcatatttttatgaaaaacaactattttcctttttttttttttatttgggatggagtctcgctctgtcacccaggctggagtacagtggggcaatctcggctcactgcaagctccgactcccgggttcacgccattctcctgccttagcctcccaagcagctgggactacaggtgcccaccaccatgcgcagctaattttttgtgtatttagtagagacggggtttcaccacattagccaggatggtcttgatctcctgacctcgtgatccgcccacctcggcctcccaaagtgctgggaatataggcgtgagccactgcgcccagccgaaaagcaactattttcaaaacaaaaatatagtgagaagagtcgttttattttttgcagatctctttaatgtctggcttaatagaagacagctggattttcctatctgcttctgcattcaatctgttgcaatatggtgttttggttgaaatataagaagaaaatctggcctaacagatatgtaattggaaaagggaagagtatttttataaccttttcagataattgtggatattcttttttgatactacagcaaaactcagcaagttgtagttttttaaaggtttgtttgtaaagtgaaatctgaaaccttatctatgaaatattcatacttcattccattgaaattcattcatctgtcttgcatttaatgcatgatactaaaatatcacacatcggtcatttagaaaatattggtccactacattatgcaaattctgcaaatagtgatacatttcattatccagtatctaaaaacatattcattaatatcatcaaaatgtgtaagtattaagttctcaagaccatggtggcggatgcaagttttccaaaatcctgatttttacttaaaacttaaattttatcattggcaagaaacactatccattgtgttccttgaattgacaggctcactttgttcattttctaaaagatgtctcaagaaccagtttgtctgtctttgaactaacagtgatattccatgataaaaacattcaactcaaaactcaaaactatcacaagtacctttatttaagacagctgttggccgggcgcggtggctcacgcttgtaatcccagcacttcgggaggccgaggcgggtagatcacctgaggtcaggagttcaagaccagcctggccaccatggtgaaaccccgcctctactaaaaatacaaaaagttagccgggtgtggtagcagacacctgtaatcccagctactcgggaggctgaggctggagaatcacttgaacccgggaggtggaggttgcagtgagcagaggttgctccactgcactccagcctgggcaacaaggagagactccgtctcaaaaaaaaagacagctgtcatactttgcacacagctgaagtactttatgcatactttccattttgtcacatacagtaaggtcaagatttagtaaaataaaaaatatgtattcctttattaaggatggttcttagtgaaactggcttttttaaactgcacgtgcgtgtcagtgaatggctttacagtttggcaccactgccttaatttgtgctaaggctccagcagctcacccactattgcctttgtatcctcagtgcaaaggcaaacacagtggaaaggcaaataatgtcttactataaagagagctttggccttccagatatcctgcaagggtttgtggactaccacactttgagaaccactggactaggatattggttttctagagacagtggaatattttctctggcctcatgaatgccctgctatctccctccttccctcttattccagtaacttttcagagcagtatccctgcactgggtctgtatgtctctctcaccccgaagcagcacttggaccttagggccttcatgaggtctaggggaggcaggcttggccacatatctgatggtgccctttcccctcagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcataccaggcccgccacccagaactatgaagcagatacactcattcattcagtagatacagtgttgagcatctcttctgagccgggaactgtgctgaggacttggtgtgctttctttcccatatccactcttttttttttttgagacagaatcttgctctgtctcccaggctggaatacagtggcatgatctcggctcactacaacgtctgcgtcctgggttcaagggattctcctgcctcagcctcctgagtagctggaactacaggcacccatcaccatgcctggctattgttttgtatttttaatagagatggggtttcactatgttggccaggctggtcttgaactccctacctcaggtgatccacctgcctcagcctcccaaagtgctgggataacaggcgtgagccaccacgctcggcccccatatccactcttgaacatcttaaattagcttttcacactagcccagctaatggccccttcccccacatcctgcctgccttttagttctgtcccttctgtcattgttcttttcttggtttgaaccatccatacattccctcagttctactctgtgacctttcctgagcaagatgctggaggagaaagtgcctgagtggttgttctcgaaacaaaaatcaccagggtctttctttgatctttcactctcaaactccagtaaaaatgttttgcctctgaatttccaggtacaggattctctaagcggaaagcttggggcccagagatccagggacataccaactgtgctgactggggcagagacctagaaggggcaagcagtgggccttctggcctgtgaagtcattgtgaccctggggagtatgtgttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaactctggtctggtcaaagagttattttcctttgtccttaaaaaaaaaaaataacaacaactttggggccccctgcttcccagcctctaactgacttcacggttgccttcacaactgtaaagccagtagtctatgaggagactcagggaagggtggcaggtgagccaggaggctgcaggaggtgtttggaccgtccaccagtaccaaaaatgagtcttgtccctgttcccatccccctgttgctgccctgcagggactgagcagcctgaggaatcagagggggcccctggcagccgtccctgaatggagtgcaggccatgtccctgccgcggcagcgcattctgttagggcagactgactgtccacgtggggcctggcctccccactcccagccccaccactcatagggacctgaagctggagcagatgtctcctgggatgcccgcttgccccaggctgcctcaccttactgtgttcactgtgtaagattcctcgtggtgtcccagagtctgggccagggaataggggacctcagcagccagaggcctgagcttgcaataatagaatgagggctaaacacagagcacagtgtcctcactgctccctttgccccactgttcatctgctctgtggctagagtgtactttaggaagcccaaatcccgtccttcccattagccacactccactgggctcaggatgaagtccatgctcccatagctgcaggttggtgcttgtctgccacagcctccaggtccagactaatgttgccttgtgtaccaggggtgtggccacagaaagctaccagtgaggccattctcagtctgcctggagtgtcctctttactgccattctgtcttaagtgccgggcgtctgctgctactatccctcctgtgcgtccctaggtggagctcttggcacatattaccatgatttgtttgagtcttttcctgggccctgtgggctcagtggggacaagattatttctcactcctttctgaatgtctaatgccaggggcagtttctgacaatagcagatgcttgtctcttggatggatagacaaacagtcacgaggactcatgccctggagcgtgctgaaaggcttcacacacgcgcacaagaagccccctcctggcagggatcctagtaggtccccagtgttctggtgctagaacactcccatttcagcagccatggccgtttggcctcctggggtaaacgtgaaagatgaaagatgacagtcatgagaaacgatgctggactgggcccagtggctcacgcctgtaatcccagcactttgggaggcagaggcaggcggatcacctgagatcaggagttcttgaccagcctggccaacatagtgaaactctgtctctactaaaaatacaaaaattagccaggcatggtggcgggcgcctataatcccagctacttgggaggctgaggcaggagaatcgtttgaacctgggagacggacgttgcagtgagcagagaccatgccattgcactccagcctgggcaagagtgaaactccatctcaaaaaaaaaaaaaaaaaagaaaaagaaacaatggtgctgcctcatgaccaacttcaagctgggaactaacacaagaatatcttgcagatttgttctaagatgagcatatggacaagggtgtatacgaagaagaaacacctcttcccctaccccattcctgccccatccatcaacctctcccaattgcagccaccttcctgccagaagtggggagaaccatcaggagagactggagacaagcaataagcaagccatcaaattgatgatgacagggccatgggcagggattggagaaccagggagccaagaggaaccactgctaaccacagacagaaccccagacagcaggtacccgattcttaacctagggttcccagctaccaaaggagggagttcaccaggggtgcaggaggaagaggtaggagacagtagttgagagaaaataatacttgtttttaataatcttgtaaatgtacataatgttggaaaagtgctacttaaaactaccactaccctctaagcatggtggatgatattcatctcaagacacccttttcctcaattaggaacttggtttgtaaaatgaaagggacctaaagctgagctccaaaaggttggtgggagtacctgctgcactatagcacaagaataattcgggatttcctgaaataattaggggtggaggggacacgcaaccggtataatcaacaagatggtgcaagaatgaggggctctgtgggaaagcaccccagtgggaactggctggcctcaaggtgttcaaagacctttcttaaatgggaagatctttttgtttgtttgtttgttttgttgtttttgagtcagagtctcactctgtcacccaggctggagtgcaatggcgtgatctcggctcactgcaacctccgattcccaggttcaagcgattctccagcctcagcctccagagtagctgggactacaggcacccgccaccatgcccagctaatttttgtattttttagtagagacagggtttcaccatattgaacaggctggtctcgaactcctgacctcgtgatccacctgcctcggcctcccaaaattctgggattacaagcgtggaccaccgcgcccggccaaatgagaagatcttgccctatttgcacttctatggagtgaaccccctccagctccccaaatctcatgtaacatctgctgtgtgcacatggccttgaatgtgttactggacactcccccagtgaagaaaacagcatctgggccaacatggcggtgggcaggccatgagtctggcatggcacgggtgacccatgaatggaattggttcgctagaagcaggagctgagggccagaagtgaccataagaatctaaacctgagaactctcagaagtccagggggcaaagggggacacaggtcaagaaatgtgggttccaatcagcctaatccagattttaagaggcagactgacctcagcttgtgtctgagttgccatcagtttacaatttctccctcctcggggtcctggagcaaagcctcatcaccctgttactaggtgtcagccccttgctaatggggtctgccttctgtggacccggttgcccaaaggagaaatctgggagccattctaaattcttccctcaacaccacagcacattgctcagcaaatcctgccagctcttacctctcagaggtcccccagagtagctctttgctgtctggtaggcaaactactaattaagccccctgcctgagtctcaccagcaatcagggagcgatcctccacacaagtgttcaggtgctgcttctaacgcaaatctgatgcttccccgctgctcagcactgtgcgatgagagctccagcacctgccctacggtagagactccagtgtggccctgtctgcctcgtcccttttatttcccactaacctgccccttcacccgaatttggccctaaccattgacagcaatttacacttgcagaataagccgtgatgtctggcctctactgtttcctctgcctcaatttctctctatcccctaccctgaccactggctttctctgtctggtcatatctattcatctttgaaggcccagcctaaccatccagtcccctgatcattcttgttcacgtttctgtctccgccaatacactgtgacctcgctaaggaaagcagctgtgcttggattctccacccgagcacccagcacaccataggtcttcactaaatgaacttgcctcgtgaggcagatggacttgaaatcaggtaactaatacatcatggcccggtactgagggaatttaacaaagccctaattcctcctaggagcatatacttaaggttttgcagaggaactaaggctgagctgagcctagggtgtaatgtgaggcttatctttctggaggaaggaggaggccactgcagagctgtggagctgcctgcttcacgtggccatcagtacagatcccagccatcccatgtcactcctgtgctcagcctcctgtcactgcattcagtgcagaggccccagcaggccagtgcaaaggctatggagggtgcacaggtctggctagctggctttcggggagagagggagctggtcccccagattcctggaacactgcaagggcaatactgggcccagtcaagctaagtttggctggccagataccacagcttggggtcagttctagtgagacaagaataaagtggttccttttgtaaactcaaaacccaggtcttgccgagaattctgggcagctcatggctttctggagaggaaagagccaggatttacttttgaaggcaaaattatggatcaggctcctgcagacaaagttgcccatgatacgtaaggagaatcagccaatgaacattctagactaacacacagaagggaaattgactgtaaccaaagccagagagatctcagtgtgggcaggtgggatgagagaaggaatatttgcggccagtcagaaaagggtcttcctcacccaaaaagctggaaatcttcaattgtttccaaagatacttctgaaggcccactatatgccaggcactgaggatgcaaaatgagtacgagagtactcatgagatggtaatttcatgaaaagaacatgaaaagtgctaagagacccaaacaaagtgatctggtaaagtaaagaaggaatttccaaccctaactggagagttgcgtgtcacgaagtaggtgacactgagaatgatggacgaattcaccaaagaaaggagtttcttccagcattgcttgaactaatctaaaaagcaggaaaaattccaacactggataaattacaacagaaaatgcttttcagtgatttgctccaaagacagtaagggatgtccgtaacaggaacagaaaatctgacccaagtggtagatgaaaaaagaggttggggtttcctcagggaaaagcctaatactaagaaccagagggaagcctgactgacgcttatcaaaaaataagtaaatgagtgatcatcatcttccctgagaatttgttgagaattttgtgtctatattcataagagatattggtctgtagttttttttgaaggggggagtgttgtactttttgagtggaggggtctggctttggtatcagtataatactagcctcatagaataagggaagtgttccctccttgtctattttttggaagagtttgaaggattgctattaattgttctctaaagctttggtcgaattcaccaataaagccattggggcttgggcctttctttgtgggaagcattctttattactaatgtaatctgtcgacttgttatagatctattcggattctgtatttattcttgagtcagttttggtaatttgtttctaatttgtccattttatctaggttatctaatttgttggtatacaactttttatagtgttctcttataatctgttttatttctttaaggctggtagtaatatattttatttgactcctgatgttagcaagtctctcttctctctctctctctctctctctcttagtctagctaaaggctgcccattttgttgatcttttccaagaactaacttttgattttgctgattttttatattggttttctgttctctattctatttttttctgctttcatctttattatttcctttcttctgtttgctttgagtttagtttgttcttcttttcctggtttcttcaggtgaatgtttaggttattgattggatttttttaagtatcagagcatactactctacattttcctataagcactgtttctgctgcatcccatgtttttggaatggtacgttatctttttgttttcattttcattcatctcaacttgtttttttcggggttttttgttgttgtttgtttgtttttgagacagagtctcgctctgtcacacaggctgaagtgcagtggcatgatctcagctcactgcaacctctgcctcccgggctcaaatgattctcctgcctcagcctcccttgtagctgggactacatgtgcctgccaccaggcctggctaatcttttatatttttagtagagatggggtttcaccatgttggccaggctggtctcaaactcctgacctcaagggatccacccgcttcggcctcccaaagtgctggaattacaggcgtgagctactgcacctggcctcaacttattttctaatatcctttgtgatttctgctttgattcaatgattacttacatatgtgtttaatttgtatatatttgtgaatttttcaaatatctgttactaatttctaaatgttgttctattgttggtcagagaatatatttcatattatttcaatcctcttaaatttattgagacttggtttgtggcctaacagatagtctgtcctgtagaatgttccacgtgcccttgagaagaatacatattctgctgttgttggatggagtgttccagagatccctcttagctctctttggtttatattgttcaaatcttctatttcctggctgatcttttgtctagttgttctatcagttattgaaagtagagtattgaagtctgcaactatgactgttgaattgtctatcctcccttccattatgtcagattcacttcatgagtatatgtgtatgtgtatgtgtgtgtgtgtgtgtgtgtgtgtataatccaaatagatccataacaagtagacagattacattagtaataaagaacacttaccacaaagaaaggcctaggacccaatggtttcactggtgaattctaccaaagctttagaaaacaattaatagcaatccttcacaaactcttcctaattttatatatatatatatatacatatataatttttttttttttagagagagacaggatctggctgtgttgtccagtctggactcaaactcccgggcttaagtgatcctcccacctcactctcgtgagtagctggaactataagcatgtaccaccatggtggcttaggagtttgggggctctgttgttaggtatatacatataattgtttaatcttcttgatggattgacctttttctcattataaaatgttctttgtctttagtaataatttttgtcttaaagtctactttgatattattaaatagtatagccactccagctctccttcagctaatgtttgcttggtatgtctttttgcacccttttactctcaacatatttgcatctttgaatacaaaatctgtctgttgtagacagtatacagttggatcatggttttgtatccattctgccaatttctgcctctaaactgaatgtttaatccacttacatttaatgtaattgctggtaaggtaggatttacatctgccatttacctatttgttttctatatgtcttgtgtcttttttttttttttttttgagatgcagtctcactctgtcacccaggctggagggcagtggcatgatctcagctaatttttgtatttttagtagagacaggttttcaccatgttggccaggctagtcatgaactcctgacctcaggtgatccacccgcctcccaaagagctgggattacaggcgtgagccaccatgcccggccatgtcttacgtcttttttgtcacgctattactctattactgccttctttttgttaagtagatattttctagtgtaccattttaattcccttgtcaaaaagcatgaatcatgaaagaaaaatttggtaagttggatatcatcaaaattaaaaatgtttactctcttaaagtcatggttaaaaagtgaaaagtcaggctgggcgtggtggctcacgcctgtaatcccagcactttgggaggctgagcaggtggatcacaaggtcaagagatcaagaccgtcctggctaacacggtgaaaccccgtctctactaaaaatacaaaaaaattagctgggtgtggtggcaagcagctgtagtcccagctactcggaaggctgaggcaggggaatggaatgaacccgggagacggagcttgcagtgagccaagatggcgccactgcactccagcctgggcgatggagcaagactctgtctcaaaaaaagaaaaaaaacgaaaaactgaaaaggcaagccaaaaactaggagatgataatcgcaaaacttatatcttataaaggacttatatcctgaatatattacttacaattcaataaagtgactcagcaaaaacaaatgagtaaatattcgaacagtcactttaccaaagaacatatacagatagcaagtaaacacctgaaaagatgctcggtatctttagtcattatggaaatgcaaattaaatccaggagttaatattacacactctcttgaatggtaaaaaatcaagactgacaacatcaagtgttgcatgaatatgaagtaaccgaaactctcatatgattgctgggagaaatgcaaaagagtattccagctttggaaaagaatcttgtgaagtttcttataaagttaaaaatatatttatcaggccaggcatggtggctcactcctgtaatttaagcactttgggaggctgaggcaagtggatcacaagggttcgagaccagcctggccaacatagcaaaaccctgtctctactaaaaataaaggctgcagtgagccaagatcgaggcactgcactccagcctgagcaacagagtgagactccatctcaaagaaacagaaaaaaaaggaatatatatatatatatatataaaaaatagcccagcaatgccattccttgagtattaagataaacaaaaatctacatccatcttgaaaatgacagaagtagattttaagtgtcctcaccacaaaaaatggaaagtatgtgaggtaatgtgataagtatgtcagtttaattatttcaacgtagtcattccacaatgtatacatatttcaaaacgtggtacatgataaatttacacaatttttctttgtcaatttaaataattacctaaaaagaaaatccacacccagataaagaattgaacataaattttcacaggagctttattcttaatagcccaaaactggaaacagttccatgttcatgaatgggtgagtgaataaacaaactatggcatagccatcagaaacattaggctaaaggagagaaatcagacacagaccatatgctttatgatgatactgatatgaaattctagaaaagtcaaaactttagtgacagaaggcagactggcagggttcgggagtgggaggaggggattgactgcaaagagccatgcaggaacctggggagtgatggaaagagtctatgacttactcgtttaggtagttgtagtactgtctgtcaaaactcattgagctgtgcacataaaattgctgaatttgatacatatgagttatacctcaataaagaaaatacgaggtcaagctcagtggctcagcctgtagtcccagcactttgggaggctgaggcaggtggatcactaggtcaggagttcgagaccagcctggccaatatggtgaaaccccgtctctactaaaaaatgcaaaaattagctgggcgtggtggcgtacacctgtagtcccagctactcaggaggctgagacaggagaattgctggaacccaggaggcggaggttgcagtgagccgagatcacgccactgcactccagcccaggcaacagagtgagattccatctaaaaaaaaaaaagaaaagaaaagaaaagaaagaaaatagaattagcactagcaacaaaaatataaggtactaggaattaatgtaatgaaatgcaaaaaccttcatgaagaaaatgataagattgtgttgaaagaattggcagggacagttaatacccagcaaagattgcaggtgatctcccacacagcacagcctcctctgcagttacgctgtggccttgtgacaatggaatataagagcaagtgatgttcactggtgagagatgtagttcagatgcgggaatctcatctagttgtctcttcttctcccacaatgatcttggagaatgggggttcagttcaagttggtatcagtgaggaaaatgctgcctgggctgcacaggactttacccaagctggaataaacctttattgtcttaaaccttgaaatttgtggctctttctgttggggctgtttgtgctcattaataccaaagacattaaagaagacccaaatgtgggaagttataccctgttcatccatgggaatacacatttccgcaacaatgtcaatgtaatttcaatcagaagcccactggactcttcatgtacctcaacagattctaaaatgtctgtggtagtgcaaagagattggagtagccaagacattccttaagaaaaagctggggggccgggcacggtggctcatgcctgtaatccctgcacttttggaggccgaggcaggtggatcacctgaggtcaggagcttgagaccagcctggccaacatggtgaaaactcgtctctactaaaaatacaaaaaaattagccaggcatggtggtgggtgcctgtagtcccagctactcaggaggctgaggtaggagaatcgcttaaacctgggaggcggaggttgcagtgagctgagatcacaccattgcactccagcctgggtgacaagagcaagattccatctgaaaaaaaaaaaagaagaagaagaaggtgggggacttactctatatcaacatactttataaagctagtgtaactaagacaattgactgtttgaatggggatagacaagctaatagtacagaatagagagcctcgacacagacccagatatgatagagacgtgacattgtattgcatattaatcaagcctcattcaagaaacaatgtaggaaaaattggttatccatatgcggcaaaaaagaaattgaactacgccttcacaccacaccaaagtcaattagagtaaggacttaaatgtgaaaagcaaaacttcacttctagaaagaatatagaacacatctttacaacatcagggtaagataggtttcttaagcaaaaaaggcactaaggaagtactagacattaaatatatatatatatatatagccaaaattgacctcattaaagtgtaaagcttctgtttatcagggaacacccctccaaaaaaagcaaaaatacaaaccataaacagatatttgcaataaatatagcggacaaaggatttagtttttcaaaaagatgtgtaaaattctgacaaatcaataaaaagacaatagaaaattggtcaaaatatgtgaataaatatttctcagaaaaggaaacacaaacagcaaatgaatatacgaacaagcatccaaccttactggtaattggggatttgcacattaaaacacaagtagatatgactagattaggaaaaataagaaagcctgatgattccaattattggcaagaatatgaagcaagagcaattctcatactctgcaggtgggagtggaaattgttagaaccacttaaaacagcttggcattatcttgtaaagtgaagattaatttactctgtgagtcagttattccactcctagatacagagcctagagatcctcttaccatgtttttcaggagccacaaacaagaacatttgtcgcagcagtcctgttaatcacaggaatgaaaactgactgaaatgtctatgttcggaagaacacatatgtaaatggtggacgattcatatactggaatgctatacagcaatgaaaacgaactatccatgcattgacaggatctcaaaattacagtattgaatgaaaaaaacccaaattattaaagaatgcatgcagcataccatttatgcaaagttttaaaattacaaatatattcagtggtgtatgaagatggtgggtatggcccacccctaatgcaggtaataaaaaggcccactgtttgtaaagaaaagaataataaaactgaccaaaatctgatttttattgtcaccatacatcagcaattctggacaatattattgataaaaattcttgccacaaaggcagctacttccaatctccactccccaccttggtgtgcaactgaatacattctttagagtcatttgtttctatagaaagagtatcatgaaaagtaatgataaaattcaggtgagaggttttccttggagggagggagagggacacacttgggcaacagcatagatgccttcaaaggtattccttatgctccattccttatgttccattccttaaactgagtgattggtacatagctgttgatattattttttatatctgatttacataatgtatctcttcagtaggtacgaaatattccaccctcaagagaaagaaaattaaagcagcaaaatcaacaaggggtgcaggtggaggagaaggcatgctttgtagtgcactggaagctgcaaacccaagaaagaataaaagggccgtggtcagtcagaagagaatgagggaccctggagcagctgcccaggccgaggctcagggcatgcgggggcctgaattggggtaggggaactctgggaagcttttgcttccaggctggggaagccacaggcctaggtgaggttaaccccaggaagtgcatctggagtgagaagacgggggacaaggccagaggcccagggagcaccaaccttttgggagaaagaagagcccttcaagctgaggctgagcttgagaaaggtgaagcagtgagcagaggatggggtcccatgtgctgaggagggcctggtggaggaggtcacaccctgctaagaggacagcaggacgccggctgggaaggaggccctggatttcacaatgtgggcaggtgaattcatcagaaattgtcagagccatgcggtggaggaggaaatgaggacagggaggggacacagctctccggtgggaagagtgaggagtagcggctgggaagagacgtggagtccaggtagggatcttacgcatctttcaattgtcccttaaaaatcccagtcgggtttagccccactagggagaaaaagtgccttcaggccttcccacagcgccagcagcacgagcacagcaggtgtcccttggggctgacgcatagggtgctcatggtggggtggaggagctgtctgcccctgtgctgggagcattctatcactgacactgtctgaattgctggtacatggtgatcagaggaagcaaactgacatttagtcacttttaccgtctttttaaaattctctacagttaacacaccctttgttgcctgcaccagggacagacagctcctaccgccagcccttgctaaggctctagtgggacgagaccagattgagtccccggcacctgggtgtgcagccccgctcctttcttctagctgacagggctggcaaattcctgcctctctgagcccctttccctttggctcactgtaactgagggaaattctgacctctggggtggttgggcagatgacagcaaaggaaagacccagggcctaccgcacaggaggtacttactagctgtccttcccgcatcagggaacagaggagacagtgactgaggaccccgcagcgaatgccccacccacacaggcttcctctcagcggggcctgtccccactgcttccccacagccccagaggccaggcctcagccattcagacgcgggggaggtgatcgcagcacagggccgcgccctgcctctgccgctccgggggtccccaaggaagcaccaacgcctggccgcagggggcagttgtcatggggacgccagggcccgctgagctgcctccttagcaacgggactccccggccagttgccatggaaacagcatcccctggcaagcggtgatggggaacggctgggtttcctgcccttttccgaggactttcccctcctagggcgggagacacggcactccctataccggcgggagccgcgaggacttggtttttccagtcgcccgtcgccaccccaggagggggcctctgcccgaccccgcgaagtcccagggcccggaggaaccctctggagacaggggtggggaagggggtcacccggggaccaggcctagccccgaacaggcacagcagtgggaagtccgtgccctgcctccttccagaggccccacatgctgcctctgccctcgggcccccaccaacccacacaggagcccagcgctgttcccccacccctcggccaccctctgatgccctcccccttgcccagtcaccttgtgtctccagccaccctcccacttctgagagcttacctaagacggcatccccctctatctagctggatggagcccaggtgcacattcaccaccctcctcctcagccagccctggcagtagggggtgggaagggtctcacacctcccccactcctgcgtttctcccctccactagcaaagcacacatgcccactcgctctcaccctcctcaatgattctcaccagtccataagcacgtgcacacctgtgtccatagccaggccttgcacatcccccgtgcacacctctatgcacagaacacagctccatgctcttgcaggcataggtttgcacatacacaagtgccctctgggccatgtcccctgccttccacacccgagttcccaagactccaggatttcccaatgacctcacccccacccctatccctggcccctagaagaaggtagcatctgctggaattttttttatttaaataaaatatacaatacggcgcatttaccggtttctgttttaaaagtggatttgaaaattccttgtaggtgactgggtgtgggagggcccattgcctgcacctgtctgtcccagtctctgcagagtggccaggttgggtcagagctattataaaatgcatgtgtgtgtaagtagagaagagggtggttaggccaggctctgatggcaagggggctcctcatggccctggaccctccaccttcacccctgctgcctccaggacaagactgtgggtttggatcaagtcctgctgcctctcagagctgccttccttaaggggaaggggtgtgtgcagaactcaggttgaggctaagtccttccagttctcagaactcctgagccagcacagtagagaccagtactaggcggcgtctagtctttacctaagatcccaggaaccttcacccacttctctcctggagtactgcctcccactccctgcagcccatctatggagaaatcggtttgtctcacatcccaggatagctcaaggcaaaacccgatcttgccaacattctggcttggagcatggaaggttctggatggataatgtgggaccagcccttctcattacttggggattgcagccatacctgctctggccctataggcaggggcagacccctgaccttggctctggcaagatcccatctgggaggagggaggatggtgcctccaaaggcatctgagctgctttctcgttcccgcaatctggaacctgcttatggctcctagttgccaggactaagcccagacaatcccttaccctatcacccaaggccgtccctctgacccctcagcctggggatcccctcccaaagccctgatccaccactccacatccacctcaggaatctccccaccatacactccatcccacccaccattccctccctctctccctgttgaagtcttcccacttctcaaggcctggctcccacccacctctggccacacaccttccttgggcccttagggaggcccagccacctcctgagtcctgagattttaagtcttggagccctcagccaaagctccctgggctctcacatagtttgctggagcaataggctgggcatatgaggggcagaagaaatgtgattttttattgagcacctaccatggtatgtgccaggcgctgggctgggcatttcacatatagatttttctcatctggtcctcataggtccttgtgaggcagtaccataattattcccattttacaaatgaggtgacagaaaggtcagataacttgcccaagatcatacagctaagaagtggcagggctgggattcaaacccaggcctgactgctgccaaaatctggtgtcttccttctgtaccatgcttggggaccatctacctcagcccccctcaacacagttttctgatggaaggaacacagacttgggcctcaaggaggcgtggactcgaacctcaaatcagtccccactctgccactcctagttacatgattctggaaaaattacccaaaactgtttcttcctctgctaaatggggagaatcaaagtacccaccccatggtctttgtgaaactgaaggagttaatgtgtgtaaagtgcgaaaccagtgcttggcacagagcagactcaataaacagaagttccgctcacctcccactgtacagatgggcaaactgacggccccagaggtggcggtgtgtgcttgaggccctaggaaaggggagtcttccacttccgtgtggtgagaggtcaggctgggactggctttgagaccagagatggggagagagggggcctgctgcgaagtcctggggtcctcttccctgaggactggagagagaacgtccctagaccatgcagtgcacagcctgtgggccaaggcgggttgctgggtgtaaggtgacctgggcatcctgtcaacatgggattaaactagaccgcacacgtgtgcgcacatgtgagtggctatctacatggctctacagagcgctacatagctatacatatacacatcttacatacatatacatatacatattcatatacagatcttgctacgtttacagtagaaaaaatgctaggccctcagggccctggcccttttctcccaaggtcgcaggcttctgaggctccccagggcacaccccagggcagcccctttctgggggcagagtggagctccaagttacagctaacgggctgatggcagctgtttctctaaatgaacacaatgacacatctgctctaagaaccgccaacactggccactcccacccctgcccagccccggagaccccatctgcctttctctggcttttgcatttgggacctgcctgctccctcctccctccccctccctccctctagtgctgagtattaaaatagtctataaaagcaagtgaccaaaaatctatagctctaagaatacctggttattttctgctgtcttttgtttttctggtgtgtgtggttttttaaataattattactgttattggtatatctcctaatcacagttaaacctgaaggaagaaggaagggagagaaaagaagaaagaagagggaaggaagggcccagctcatagattggatggcagtttggagcgcactggctcaggcctggccccaggttccctctggggtccagcagtcagagggggccccccagaagaggtggctcttgccccaaacaaagacagagggggtggcaaagaacctgaggatgtcttccgaggcagagtgacgtgctggccggggatggcaccatagggcctcccagggggaccgaggcccccgctgctcccactgcccccgctgccacccccagccctggggaagagcgggaaggcagccatggactcccctgaggagtgcggggaggctctgcggagagtctgcgccccgtcctgaggcagggctggctgagacgcggagatgagcttgaggtcctgggtgaggcggccgggggtgagcgggggtgtgccccggcgctgggggacctggggtggtggggggctggatgcaggtggcaggagcaaggatccgtgggagccagaggcccggggcggggcactcgggaaggttcttggggggcctgggctgtggccaggggggctgagacctcctcggggagtaaagcctacaggggaagcccccccagaggcccctgccacaagggacggcggctcaggctgccgtgggggtgtctctggcgtgctcagtgggccagtggccagacctagggacaactccccgggaggctggcccagctgcccggggctagatgacggggatctggatgagggtgggggtggcaggaagtgctccgggagtcccaggcctccccgggccccgggtggcgcgggagatggctgggcagcctgcggggagcgggcgcctggctgcagcggggtgagcaggggagagtcggaggaggacagggagccacccagcgccttgtggaagtggccaaacccggctatggtggtggcggctacgccagctgatggtgtgggagccgagggggagccacaggccccggggggtggggaggagctggatgagggcaggagtgggctcagtccagcgggggcagagaatccagccagctgttggatgtggaaggaggatgaagacggtgtgtccacctgggacgggctgctggcgggcgaggcggagcccagcgcagaagggatcagggactgcagccgtttcaggtgccttggcgtctgcccggcaccgaggttgcccagcccagatcctgggggagggcggaagatggcagcaggcaggcgagggtggtgggtgagggctatggccacagaagtggtggcagcggcagcctgcagtggtgcctggatcagcggggtccagatgacgggcgtgggggttggggtggcagaggcagcagcctggacgcggtgcgcgcagtgggccatctcccggtcatgctgcacaatctgctggatgatctcattctcctggtagttgaagacgccggagttgaggtcgtgctggactttgtggaggaggatggagttcttcttgcctgggccacagaacaagaacaggcactcagggcagagcggggaaggagatcaggtgcagacctggcttaggcataaaggagccctgccctcctcccccaacaccccccacctgccccgcctgtggcccctccccctcaccaatgcggtccaggcggtccagcgccacggtctcgaaggcccttcgcatcatggggtactcctccagcacctcattgaagttgtccacgctcagcgagtagaggcggcagtaggtgtcggccctcacgctggctgtgcgccggccccgggtcagcaggcagatctctgccagagcatcaggactcaggatgaggcatgcacagcctgcccaggccagggggactgcccaccctgaccttggccctgactgcctggcacagaagccttggcaggctcacaaggccctgcccccagactgcggccacactggatgcctcttccccaccaaatgggggctggacagactttcccatctttgggacataccctctgctctggactgaatgtgttcccccaaaatttatatgttgaacccctaatcccagcatgatggtatttggaggtggggcctagggaggtgattagatcacgagggtggagccctcgtggatggaattagtgcctttttaggaggaggccggggagctggctcatcctccttctgccacatgaggacacagcgagaagtcagcagtgcagcccagaagagggccctcaccagccccaaccatgctggccccctcagctcagatggccagcctccagaaccatgacacatacatttctgcagtttacaagccacccagtctgcggcacttttgttacaagaacccagactgactaagacacccctaccctgggctcacagacacctccctccaggctgtggccaagaagggtgctcactgcctctgtcccctcggtatctccccaaaccagcccctgggagcagctgccctgtcccccagggcccagggctgcctcacctccaaagtaggagccgtcggccagcttggtctccttgttgcccttggtgagcacgctgaccacgccatgctggatgaagtacatcttcttgccaatggtgccttcccggatgatgtagtccccaggctggaagacctcgaaacgcagcttggtcagcatggacgtcacgaagttggggtccgcattggcaaacagtggcatggaggccaccagcttccgacagttaaagttgatgatctcctgccggacagggtggattgggacacgggaaggaggtggtgaggggagctggctgccaggaaggcctggctcccctccacgccgggccgccacacagctcacctcccgcaggggctcgcttagctcgcccaggatgctctcctcgtcgaacatcttgccctggtagcggtgctcgtagtagtcgtggatgcgctgccgggtgtcgggcgggagcttgtgaaaggacatgtactgctccacctgcttgtactgaggccgggagaagggggcgtcagctccaccccaccagggggcgtcagcagccagccccaccacctcggcaggcaccacatccgggcacccaccccgggggatttcctggctaaacttggttccttgagatctgaggtctacagtgtggaaatgacctcactgtgctcaaaacaactgcccgggctcccagctgcttggcatggaggaggggcccccaccagcatctgctcctcgctgtgttcaatactaaggaggtgggtgagggcggcagggaatgtccaaagcccagtgacaggacatcaactgtatctccagggaggtcgatcacatttccttggaatgttacactggggacagggaggcctcaccgactctgcggggaaagaagctgtttcctcccagcagtgacaactggcacagtcaggaggcaagggtgcgatggatcagaacgctcagaggcagaagcaaggatgcctggctgctcgatgctatgaatccaaacgtggcctcagctgagaccccgggtcatttcgttgagagcaactccaggtaagggaaaagcagggtagactaatttgaggggaccttcaaatagaggctcgggtacaaaagatttgtgagcctcagaccctggggctcaaacaaataagaaacgatcctgcccgccctcactgagaggagtggacattgctcccaccatcctagattgtgggtggacagtgggattcccaagagcaggatgagggatgggaggtattgattaggcaacaacacagactcctcccggatgggaagtagaggaagtccctatcaccccagcagcaatcagaaacggggcagcctgtttgcatctatgtgtgctccaaagaggtgggaacgcacaactgctgcacagaaacacccacgggcaaatgagggctgagaaatgacatttcctaaacttcttccagccaccctggcctctgactgctccaagttatgcaaagtcccaggggacagtgacttcctggctggttacagagatggaggcagctggaaaacctggagctgtgttttagagagtccctcccctgacccccagagaacaggtaggggtagggaggcagggtctggacatggggcaggagttaaaaggttgaagtggtccaggtgagagacagacgtggggatggagaggagggaagacatttaagagaaatttattgggcagacttagatattagccaaaggacaaacattttaaagtctcaaatgaaaagccacagacgccttgactctggccctaaaataaactctgatgcattttcttttctttttttctttttatttatttatttatttatttattttttttgttaagacagggtctcgttgtgttgcctagactggagtgcagtgatatgaacacagctcactgcagcctcaacctcctgggctcaagcgattctcccatctcagcctcctaaacagctggcactataggcacatgccaccacgcctggctaatttttgtatttttagtacagacagggttttgccacgttgcccaggctgctcttgaactcctgggctcaagaaatcagctcgcttcagcctctcaaagtgctgggattgcaggcatgagccatcatgcccagcctcccagacgctttttctttttcttttttttttttttttgagatggagtctccctctgttgcccaggctggggtgcagtggtgcaatcttagctcactgcaacctccgcctcctaggttcaagtgattctcctgcctcagcctccctgagtagctgggactacaggtgtgcaccaccacgcccagctaattttttttttacttttagtagggatgaagtttcaccatgttggccaggctggtcatgaactcttgacctcaggtgatctgcccgccttggcctcccaaagtgctgggattacaggcgtgagccacagcgcccggccccagatgctttttctaaactaatccctgatcttgaccccagactaaaacctagccttgatcacacactgagccctgaccccactcacatgctgagccccaccccagtcacaggctgggcactggtgctggctccagaaggatccctcacctggctgagccccaccccagtcacaggctgggtcctggtgctggctccagaatgatccctcatctgggcccggactaagccctgacctttgtagcttgatgccttctctacctccctaggaggtagagaagggtcctctaacctaggaccctgtgttctagccaggctaatttctctgccaccacccctatgctcatcctcatcctgatgcctggcctagaattctcttccaccttctccttcctctgcttccccacagtgagctctccttgcctcccagctctgtaggctctcctgagctctcttcttggcatcatgggacctggacctccacacctgggtggcccccacctgtcagtcaccccaccaaaggacagtgcctgggacaggcaggcaggcagtgaatccacaaatgctgaccctactgtgtgccaggcatggggcataaaacagaaaacgacatactgggtcctcccctcatggagccgtggcctggagagggaaggtgggtttgttaaacagatggctgcctatggttaattacatcaccacagagtgccgagtgtggtgaaggaggagagggtgccatggggtcacatgacaggtgaggggctggccaggtcacagacggcttctctaagtggtgaggctggacgtggagagggtgtcaggtggacacctggggaggagagttgagggtgaaagcccgtgtctgggtcccatggcaggagcaggcatggggagagaagtctggccaggctgaaataaagggtgcaaggcccagggcaggagctgagcatgagggcagatccctggttatgctcctcaaatgccaggctgggaaaacatgctgaggagttaatctacatcttcagagcaacgtgaagtccctgaagagtttcaagcagaggatgaggctgacgtgttttagatgccgctccaactgctgtgtgaggtgtgcagtggaaggtgccagggcagaacctgcttagctgataaacacaggggagcttacttgcaacccccacagcctgatgcccagtaccacccccgccctgcagatgaggaaacggggcctcacgctgtggaggcacaggcccacgctcaaacagagctcggcagcagagaagctggggtagggcccaggtggcctgactccaggccacaggactcattctctgtggtgagggggctgctgttgagaccccagggagagatgaagctggggacgggggaaggtggttgggatgcagagaaggagctgtggctttgaggtaggcattgatgacagagagaggccagggatggctcctagtctctggcctgggcatctgggaagagcagagacttggagtagagagaacagggcagccttctcattacagacatgaggggcgtggggtgtccagagagggatgaaataaaccacctggagctgagagatgaggtggggctgctgatgctgtgcaggccccactgtgcaaagatgggcacagagcctgtgggcctgggtggtgaaaccacagcaccggggccccagacagagggagggtcaggggcgaggcccgggccactggggactccagtggcagtgactgggaagagaagccagcaaatgggggcaggggactggccagaggggcaggagcaacaccgcgagagtgcggtcctggagaacgagtgagcagccaggaagggcgtggtgactgtcaaatgcctactggagcagcacggagggcacagggcctcagccaggagccacaggccccagtgacactggagacggggaaggtgggaacagaaaaaaagacatgtggaggggccaggccagggagctgaaactcagattctcatctcagaggtgtctccctcctcctgctcttccctcacactgggagttccgatcctgtggggtgggagcagggggcggttcctgctgggggcccactggctggtggcctgtgctccctcttgggagggaccaatgtgcgggtgctccctgggtagacctaccttttcctggtactggcgccgggaggagtccagggactggatgagggcagtggcgtggccaatgaacatggcgtagcaggtggcacccacgatcatgctgagcatggtgagccagacgtcggacatgcccacgggcgcctgccgcccgtagccgatgcacagcatgtggctcatggccttgaagagcgcgtaggagtactgcttcccccaggagttgttctgtggacagacggatgggtggggacagtggatgagagggaaggcccttctcactagcaagaaaaggccctgccacctcctcacctcaacctaactttctcagtggctgggcccagggctccctaaccttgctgttggctgaaagccttgggtgagaagcagcctgtgctgccagcgagtcctcctcttgtgccttcctcttgcaatgggggcagagatcagactggaagccccagtaaaggtacgggagccagcgtggcccagcccccatggggcagcttggagcctcctggctgggtagcaaaggccccgggctgagccaccgtgctgtccttcccttgctaaaacagctccaccccccaaccccctaaacagctgccaagtgaagcccatttccccactgacctcaattataaaaccagatatgcttcccttggggggacaagctctggcggactgagccgaaaaacactgtcctcattttggatgagcaaaagttaaagctgtgagctaacgggcctcctgcatgaaccctgcccgcctctgctagggctgcggccaccagttctcctcccactacccccaaggcagactctccggaacacacaaggcgtggggacaggaggagggaagctcttggctatttttgtctacaaagccagtcggtgtctcaaggaaggctcagcgtgggaacactgggatcggaagggccatctcttgaatttagtgcatgtgtgggcctgccaccctcacatagagaggacactgccccagatgagggcccattgaacctgacgaatgccagcactggccacctccctggtgtctttctgctcacagggcagatgcatgagccacagtgcagaaacctacccaggcccacagagcacctgccagaggcccagcccccaggggaaggcgcaggagcccgtgagcttcgagccatattcaaggtcagccagactgccctgaacagagctgagctggctccttgggtctgatggctcagtctagactggagtggggaccaggagggctcatccccaggggtggaagagacctgggttcccagccttggggaacaggggtaggcccccagcggcctttactgctgagcctctgggaacagggaattcaatccatatggctgattcatttacacttagctcatcaaaaggctgttttgtaaaggcctgtttgatgctgaaagatgcctcagggtctctttcacctctttcaaagccaatttttcctcccctggggccctgggaatttgccttcagaacaaaccaaactgactgggaggaagcctgggagaggcaggggttcaccagagacacagaaaggctcacagatccagggtgtcttctgtcctgcctggaacccacctcatccacagggggactggaaactctgccctatggcttccgaggccccaagttcaacttctctcacccaccctgacccacttgcaaggttggagggatagggtggggtcaggcttcatcctgcctgccctccctatcgggactccacctcggatcaggatatgttggcgagtgggggcagcccagctctgctgttggagtagaaagtgaccacatatgacctgggagtctgcgtgggctgcaaatagtacccttgaaggcgtctgttttcttgggctcagctttttgttttttatttttatttatttattccttttgagacaggatcttgctctgtcacccaggctgaagtacaagcgagctcaagggatccccctgtacagccgggacacatgtgcttgccaccacaccagctagttttttaaaaataaattttatttatttgttgaagtcaggggtctccctatgccgctcaggctggtttacaattcctgggctgaagggatccccctgcctcggcctcctaaagcactgggattactggtatgagccactgcacccagcctcaggctcagcttttaaggacttggcttctaaggggcagaggcaggaggccaggagctgccagcccagcattgccatgcctgggggaggccgcccaggtcttagtctccctgggtaaaatcaagatgaaatactgaggctcccagttgcaatggaggctgtgagaagatggaggtaccagctcccaacccagagctgtgaatggatccctggactggcagcaagcgattgggcctgtactgggtagagctatgtgccccctcagccccaggcagcactcagggtcctacatgctggaactcagaagttccaagtccacatctcgccaccctacctctggagagcccgcctatggcccagagagaggaccgggctgggcgcactcaccaccatgttgttgatggacacccagcagtcgtcagggaagtcctgtagcatgggtaccaggaactgcaggcagccgtcccagtggcagagcaggagcatcatgccgatgaggttcacgatgcgcaccacggcgctggccaggtcgtaggtcatgtggaagatctgccagcagaggaggagaaattggctgggataggtgagtggccaggagggccagcggccactttccctgccctggagctgctggtgggcactgctctgcctggactctgcagggcgcccactcagtgcaaatccaggctgggggtgggatgggaaggcgtcagtctaggtcttggaagaggaagactgtaggctgcagggtcccagagggacatctcctggcatctatacagatggggggtcttcctgaaaggtctagccatccaggacatgtggaaggacacctggagccccatgcagcccagaagtgggcagagaagccactttctcagctttcctggggtgtgaggataccagggagaaaagcctgccagcctgaggctcctcagggaaccaaaagtctacagacatgccaggggcgtgtttccctaaatctatcactaaattctcaagactcacacacggtagccacggaactgcagaggaagcggcacaggctcacaggccccaagttcaggcagaccttgatcccaagcccaggtcctacccagttcctagctgtgtaaccttgaacctctctgatcatgttttctcatctggaaaatggtgataaaaattcttatctgagtgggctgtcaaaaggactaaattatacatataaagtgcttagtaatgggtagaggagtgttcaataaattacaaaccattattaattgataagctgttattaataattaatcttcctgattggttaatacgtatttggggtaatgttctcctttacagcacccttgaccccagcccactggcaccagcccctctctactcctgcagctcggagtggggggctgcagtgtagctggacagggccaaggtgggcatatcccagcccctcctcctcccaaagctgccatgctggggtccccttgctgacagggcagtgggggatggagaggtggaggcaagtctagaggaaagtctctggaagctctggccttgcttctgtggcctgggagactttgaagtgggtctagccacccagcccccattctcatccctccatactattcccaggcaaagacacccctcttggaggggggcttgggtcaaatgccacagagacctagtttaagcccatttcagatgtggaaactaggcccaaacagacagagcctagatatgtcagcccctgtctactggtcttccagctacagccctgtagctagtggcaagctgttctgatactagtgaccgaagatgagtactttttgtccacagctcatcacctgcagtcacccccacctgtggcccccatcaagggcatgaccctgaaggttccagctacaaagctgggagtctttccaggatgaagtggacagcgaaaggttcatggggtccggtagcttaagcttgccccatcatttccctgtggccctggtgacagaggggacaatagtgccacacctgactgtggacatgaaattccacagccatcctctatttaaactcacaaaaatcctttgctgaagatattgttcatctgttttataccaaggctcagagaagtacaggaacttgcccaagatcacggtggcagtggaaaggccagatgttgtagccaggtctgcctgattctgaggcctgtagccaccatattagattgttagattgacctagtgaggaaagggtagctctcagcagttccattttgtggataaaacaactcaaacccaaagtggctgaatgaggtgcccagattcacacagcaagctgggtcctaggccaggtgggaattgccagcttctcgcctccccagcccctgcacacagtgtgatggtgtagacggtgctgtgtgccctgcagcccagtaccactggggcacagaccagctctggggctgtcagcgtttgagctcctggctaagctgacactgctcagcatctgccatggcctggaaggaatggtgggccctggagagcaggccggtctgtggctgggctggggcctgggtctgggacacagagcagatctgattatgaatttggggtctctggtccattttctgtggctggtcatgttcaggcacctgtatcctaagaccgtgaggctctccccagcaggtccctgagcaccagagcccccagcaccagccggggggaagatcccacttttgcctccttaattaacacttaggtgaatgtgacatgtctatgaccctgggcaaatcctaacctttctatgtcttggttgaccaggatgccactagctccccagctcacccaaccccctggtgtctgagctaagacaccaggggtttggggagggcgagtgacacagcaccattcacggtctcagagccggccatcctccacacctgcctccccaccaccacaactcagcctccccctcaaacaagctagacatctgccccctgttttacaagattgcttgtgaattaaactagctagcaaagtgctctctgcacacccgtcatagacgcaagggtggggccattattattaagctccttctcttcccagctgctagggactgcacctttgtgtccctctcaaattcctacgttgaattcctaaccctcgaggtgatggcatttggaaatgaggccttcggaaggtcatcaggtcatgaagttggcaccctcatgagtgggatgagtgcccttataaaaagagaccagacagagacgatctctttgtcctgtgagggcacagggagaaggcggccgtctacaagtcagaaaaaaaaaaggccttaccagaagcccccgtgctggcactctcaacccagactgccagcctccagagctgtgggaagtagtgtttgttatttcagcgcccccagcctctgttgtttatgttgtcacagcctgagctgactgagacaccaaccttcagaacccagccctctgccacagacaggaaagctgcgcaggaggccaagggtactggaggcacagacgggggcccgtgggggcaggacagcagcctccccgaggcacatggctgagtgctgagctggggtaatgaggcaggcctgccccagggttggagagtccaggacaaggggcaaatcaggttccacaagccacagatttggatatttaaagtcgtaactcaagccaacaaactgttaaagaaaatatattctattctcctaccttgacagaaggcaccatcgtaatgccctggagggccagacttgaaatgagaactcttacaaaaccacaccagagcacagcccacctcccttctcttccctgactgtgccccccagcagaggaccctggcccacagccaagccacatccatgccactcctgcgaacagccacttgtaagtgggtcaaggggtgggcacagaggcagaatggtcccctcaggacatcctgggaacggccctgcacaggccttgacagcaagcttagaggtgtctgtgccaggaatgctgggtacccaagtgtggtcaagaaagagttgcaaagagcccccagactcctcactgtggggagaggagccttccggagtgggggccagtggggcccttctttcctgggtctcggggcagtacccttagaaagacccaaatgtctatgccatgtcccctggaagtcagcctgtgtcagtgcccaagaaagcccccctccctatgggggtcagggaggaaagtcttgcccttgcttgcccagagctcatagtctggctggggaaggaagccgcacccaggaaagggacttgggaacatgtatatagaaacccagcaacagaggaaggcaagcagggcacaatggggaggtgagtagagaggctggtccaggctctgagcacccccagcccagatgctgctgtggggctggacagcacggctggtagcagagcccacagccacaagcatgccgttctcctcccacccctggcttgtcaaggcagcaggaattctgctgaaagtttctttagttgaggagggtatcaaagtctagggcatctctggaagcaccctgagtggggtctccctggctaaagggctccccaggatgcaactgtgttgccgccatcacaaggggctgtggagaccggcaatgctcctcctctgatgaaggcaaccttccctgtgctcctctttcaagccctgggatacccccagttccttgcttctgtcatgcctaagacacacaggtggactcagagtaacacaaattggctcgtatgtccagctgtctcggtctatctctacgtggacacatccaaaacctgtttccatctcacaattggtgtcgctgttcgtgaggctgagcaacaaaaacccaccagccagccgtgagtgagtctctcatccctccccacatcccatcaatccaggtggttttggctctactgcctaagtggacatctcaaagccatttacttccctccaatcccaatatgaccccaatctaaacacccgcaagatgacagccccaacctcttgatgaggctccccgcccctccaagccactctcaaccaagcagctagaaagacctcttggagacataaatcagaccatgtcactctcttaccataaaccttccaatgacttcccactgcacccatgaatacactccaaatgccaactgtggccctcggcatctcggctcccaactaccggcctccctgactctgcccaaagccatctctggccacagcggccttccttcatgtccttgaatgccccaggccagttcgtgcttgccccaggccctcagtactgggcttgctcttccatctgcctgcgtgctgcctccagctccttcttgtcatcctgtcttggctcaaaagccacttccatggaaaggaaggacactggatccctgtgtgtgacacagccaagggctctcccttcccattctcactgtgactctttgccctgatgaatttccttcctggagttctcactatctgaaatgacattcactgacttgcgtgctgctgcacgaggcagggctcctctctacttctcacttctgtgttcctccatgcttagcacaagcaggcatcaaaaatatctgctgattgcctgaataaatgcgcgtacatctaaatgaatgagtgggtaccatatgggagctcaaggaagcctccgggcatggctagaaagagtcccagactgtcacaggccacagtaactgctcctttggacagatcacgctgggccttaaagacagagcatcgaaggtggcatgttttcctgcaatgacctcctttccttctgtatcgcctttatcttttcattactccttttcttctaagatcaggtccttgtctaattgtgcctttatcgtgatctcagcaatgaacacggcacagagcatgtggtaaggtttcaggaactgagaagggcttcgtgatgaaggtgaaggcaatggtgacagtgacgagaatggtggtcagcagggctcctgctagtgtagacagtggaagaacaaaaaggtacccgctctgggcagatgcagcccacagggaacctacccttgtccctgtgggaagaaccaaggtgccttctcctgcaggggacacagacttccgtgtcctactgagagcatggtggtggtgaagcctggaactgcggtgaggaggactgtgggcactggggtggtgggtgcaggtggcagggctggagaggtgtgtttcaggtggtttttagacaccacaaagctggagcgccaacaacgcacagtctgagctgcctgggaagagctggtgggggcacatccattcaggttagggggtgccctagatttgaggacactcacctcacctgcaccactctccagcacctgggaagtggttgccgagaacaaggctggacgttgctgggagaggctgctaaacactggtgtgtccccactgttggctggggccacaggccaccggagagtcagttgcaccaggcaaatatttgccttgctctttatatttcattagaactccctcttacgatgttggttctgactgcaggggttgagcaccttcatttccaggccactacaagccttgcccgtcaggcggtccaggcagctcactctgccacacatggaacttggggaagccctgctctcactccttctgcagtttctcaactgcagtgcaaggacagagccactgccttttccaccccgagcctcagtttcctcatctgtggaatgggtaattgccagatctcagggctatcatgggggtcaggtgagatcatatccaccactagcacatggtaggcactcaggacatgttggttcctttccttccctctctttcccagccctcccaacaaagagttgatttctcagtcccaaggagaggccagaaattggaggtctggctgctgctgtttccaccaaggcctcttcctggggcctgattgaatcctctcctgtggattcattttctcctcatggaagaacaacttccacctgtgtctcaagaacaagtgtctgcgttgaagacagcaaccccaggcctggcagaacaggctgctgcatatgcatgctgggtgcagtttgaaggcagctgcactgagggtcatgccgggtcccatcctgggtgcaggagacagggccagtacccacgccccaggacctctccttgtgtcatctccacttctcgcagatgccaagcacctgattctgagatgaggcaatcaaggtctacaggatgaggggactcatcagaggccacacagcagccccagctggccttctgcctccagcccctctttggccacttcaggctgccaagggagaggagagacttctgggatgggtcactggagtgctgagccttgcagggtaacgtccaaagaagggtaaccatggtttctaacaatagcctccatgcctggaacaagctcacacctcggagggagggaggaggcatggctggagaggctcgggagggagtctgctgacccagatcgcccaggatggaggcaagaggcttgcatcctccaagatggtggcccacctgcgctgactcacaagactgcctgactgccaccaacacttaggagatctcctgggggcctggtctgggcccggctgggggaggcagtagaagcctggggtcaggagtctagcttcttgcagtgccaggcagcctggggcaagctttccccagtctgtgggaggcaagctccctagccccaaccgagggcatcctccttcacgttccgtgagctacaacaaggtcttcagaatcagctaacataaaccttgccaaggcagatgggagctggggactgggccccagggagccacagcttcagagaacatcattatgtgcctcacaagtggggaaactgaggcccaaaggaggaaagagactcatagagggacttgaaagaggagattagggcagggttttctgtactaaatactctcctcagctctcatgtggacctagggctccaaagggtctttctgctgctgcctctgggccaagcagaggtgggagaagcccccgggctggagtggcctgctatggtcctggagacagggttcctggggccagctgggaaaccccagtccaatctcaggggtccagtgagagccctaggctggccagtgtgcccggcagaaactagctcaaagcaattttcttcccagctggtaggagagataaaggtttgtgtgtggaagggtgagagtcatccatctggcctcctgggatcttcttcctccccacgagatggggcggcacgtctagttcagaggcctgactcaaggcctcctggggcctctgcctcccccagagaaaggccaggaccagcgcctgaccagttctgggtgcccaagagggtggcctggccagggtggcagtggggacaggagccctgggcctgagctcccaggatgcataatgtggggacgtgaaagacaagcttagctccaacccacgactcaccctgtccagccactggcatctctgccaactcctacaaaagaccacagccctcaggccctggaggagtaaggtcagcccctgggaggctgaggcctggagacacgaatggatgctggaggagggaaagagctggcgtgtctctgcttttcatggcagtctagctgtgggtccaagacatgcagaaggttgggggtttctcagggtctgagggagccaacctggtcctacatttccacctgcgacggaaaccaggagacaagtgtgtcagagcatgaggggaaacacgcctccatctttccttcacagcccctcagagtggacccagccgcaccctccagagtcactgtcccctctcagccctcagctcagaccacctgccacatctctgcacatctctgtctcacaggcacctccaactcaacctgttgcacagatctcctcccctgccactgccctcccactctctgccaacagtcgtcctagtcctttgatcccagcgcccacccaggccagcacaggtgggtgcccggcaagcacttgctggactgaatgaagtccagtcccccatggaggggccccagccatgaaaggaaacaatcgtagaatcaaagtcattccctttccatctgagaaggcgggaagtgcatggaacaggaagacaggaggcctaggccaaaagccctaccactggggcggctggcctttctgatcttcagtttcctcacttgacacatgaggatcataaatcttgccctgtttctcttgacagctaagtatggggaaccaaggaaatgttactaagacaacttggtggggagggaggtaggtgtgtgtgtgtgtgtgtgtgtgtgtgtgtgtgtataaatatatatatattataaatataaataacatctatttatttatttttttgagacggagtttcactcttgttgcccaggctggagtacagtggtgcgatcttggctcactctgcaacctctgcctcctgggttcaagcaattctcttatttcagcctcccgagtagctgggattacaggcgcccaccaccacgcctggctaattttttgtatttttagtagagacggggtttcaccacgttggccaggctggttttgaactcctggcctcaagcaatccacccatctcggcctcccaaagtgctaggattacaggcgtgagccaccgcgcccggccaggagggacacatattaaacagttcttctgcaccaggcttcatgctaaggctttataaacatcaggtacaacttatacctattttgcagataaagagactgaggcacagagaggcaaagtggacccaaagctacatgctaggcagtgtggagccgggattttaacttgggtcttaaatgcgccattccactacaccggggtgggacagcccacactatgtgctgggggccaagagggctagctggattctgtcccagttctaccagaggtctaactgcatgaccttgggagagtcacggcccctctctgtcagcataagtaatgtgaattttccaagccaaagagaatttctgccatggagggacgctgccaaactggtgcacacacttctcctatggcacatgcgttcatgacgcctctgaccatcagccataggtgctgccagtcgaggcccaggctgctgctgggggtgagcatggggggcttcatgtcctgaacatgggaacttctgccaggcaagcagggggtcctggaggctgggaagtcagccacgcggcacagggatggagcgggaaatggccctccatggaagcttgtcccgcccacaggtggcagggatccaaggtgggctgtctcacagagagagtaggccctccaggctggcctgcctgccgctgctgccaagttgtgtaacttgggtgggtggcagacacagaccgaagcacttggcaaggtcagctgctcttcctcccagcaaagcccttagctcctctgctgcagatgactgcttcagcccatggatgagtgaggtttgttcacaatgcagttggtccgcccagttctttttcaatgttttattttcctcctgtagccagtgttcacagcccctaggatccctttacagtttctgagcacaagactccaacttgcccgcgtgatttcactctctacagccagcggccgcaccttttgtcagaggcctgcccgggctgctggaaactgctttggctgtgagtgctgagggctggcagtgccttgaaccaatgactgacaggtaaggggatataaacattccaactcccttgccctgactgggacaactccaaggtgtggcgcacactatcctcagatcccatagggctgaggcaaacagccatccacaggacaccctccaatgtccaaccattgcttggcttcctgcctttccctgtccctctccccagtccccttaccagattttcctgggaatgcatccccaaaacatccctttcatgcaaatctttgtctcaggttctgctcaggaagaacccaaactaagagagttgccaacaaaatttgtataaaaatccagatttccatttctcataatgctatagatctagcaaccctgggcccattcccacttgacaaaaattagctggagctgcatagaggccacccaatataacggagatgttctctagttcttctcatccaccacactgtctactgtcccccaactggcccttttcacccatccctattccctgcctgtccccaacaagtttatgggtttacaaaccctacaacataacgcagtggttaataatgtgggctctagaggtgatcggcttaagttcacattccaggttcacaaattactaatcatgcaaccttgtataagtcacttaatatttctgtctgtttcttcaggtgaaaaatgagtatatacatgtacctatatggttccctctatagctgttacacacttcattgagatactgcatgtaaagtatccagcacatgataagaggtcaagaacttactagtatttgtcctcttggagcaggtgtgcctgccacaatctgacagcctatgttcaattatctgaggttccctgccagttcctcactccctctgtggggagtggcctttcccccaagaggtttgcactgaccacttacctcttcccactggtgaatatatcgaatgaggcgggagaggcgtaacaggcgtaagaggctgaggatcttcgtgaagcggacaatgcgcagggcccgggcagtcttgtagacctccgagtcgatgcgtgtctccacaatgaggaagatgtagtccacggggatggaggaaatgaaatctaccatgaaccagcttttcaggtacttcattttaatccgctgcgggtccaggatgatctctgtgttgtcctccaccacgatccctgtgcggaagttgaggaccaagtcgatgaggaagaatgtgtctgacaccacattgaagacaatccagggtgtggtgttctcatccttgaagaaggtgatgcccacaggaatgataatcaggtttcccaccatcagcagcagcatggtcaggtcccagtaaaatctgcccagagacacaggggtcagtcgccaggaagagagagaggacaagttacagactaagggaggaagatctgagggacagcatctgggacagagaagtcttgggaggttctgagacaggaagacaggcacatgggtaccagggcaagatgtggagattggcacagggaatgacacaataagaggctcttcattcactaaggataccctccgtgctgcccttctgtgagtttccccgagccccaacaacaagcttcctcctcccatccccagcccgcagtaagagtcaggctgaaaagcaaatcagtgacactcagagagaagcaagaggctgttttagcaaaaggagcagctcaccccacaccaccccaggctcaggctaggctgccccatcctccctgagggtcagctgtggcttgagatgggctgtcagggagacattccacagaccatgaccaaagagcaggggaggtacagacatgactcaggtgcctggaaggcaggaggcccaggctccggccccagctttgtcatcaacatgctatgtgacatccggaagggcctccctattctgggcctcagtttcctcactgtgtaatgagtcctatcattctgatctggccctctcccaaactggttctctggcatccacctttagtccatcccctataatcagaaaatgtctgaccatctccttccctcagaggtttgcatcctaacatgggggtgtggagggggagagatagcttcaaaacaagaataattaatggggggatttcaggcaccagtgagataccactcaatgtgatagaaagagaccagcccagggcttccagaatcatttctcctaaggcctcaggcaccttcaagtcgtttgtagagggagcctcagggcaaagccttggagaagttgagcagcatgaggaggaggcacaacaccaactcacaggtctgtggtgggtttctcccaactcaccaagcagggggccttctggagtgtggaaacaacacaggtggccaagaccccaatccagaaggcatggccagttattcccagggaccctgcccaagcaccagccatcccagggctggccccaagaccaaaaacttgcactgcagagctgtttccctctgctattaatttagacatttacacaataacagataaaggtattaagtgaggcagaaataagcatgtcttctcccaggagaaataacctttccaccatctttgattctttactgcagggaagccaggaggaaggaagtgggaaagaaagagataagctttcctcgagtcttcagagggtctcactgtaaaccaaagtgcccctgcctgcagagttccaggttgcaaagaaattacttcatagcaaattgtttgtttgtttgccagactcaaaatggggctgtgattcaaggagagggtagggcctgttttgctgaaggtgggtgagatggctgtcctacatcacactgtgtggcaaagggcagtttccagagagtcagctttctgcagctcctttgaaagccaagctcttcagggcctcaagacagggccttatgggggataaggccggatgccaagaggccaacttcagctcctctctaccccatgacccaccactccttcctgtggccccagtacccatatgccagctgagagaacccaactaaggcctgaggacccatcctcagcttcacactttactacaaagaatgcagcacacctgctaatgagtcatgggccccaggaggatggtttcagcatctatggggtgccctagagccgtgcatgctctacccagccacatagacctcactcaaagacagctgtgtacactcattagatgccacacgcaggtatccccattcacacacacagtgcacaaacacccctctatacactctgctgtcatccctcttcatttaatctcctgggaaaaacaaaagaaaacaaattttttaactgtgcatagaaaggccactgagggctatgtggccctctgtacataaagctaataatacacccaggctggaggagtttctaaaattaacagagcgggtgcaaggcggctgggaatgctgactcgggcgggcctgccactccaacgggtttctacactctccccagctctagttccctcaattacagtccaaatttgagagagtaattaacaggagaatgtttgcattttgtggtcttcataaaaccaaattgcataaggcaaaaacacccatttcctcgcactctgactaatggtttcaatcttgagcttccagatgctcagggatatttccagcactcgatctgggctggggtcgggatcctggatcattctttcccacaaaccactaccctggaacatcacagagctgctggagagacagtataatatggtgggaggagggatgggcctgaagtcagggttcgattcctgctccatggtttactagcaagtcactttaccatgccacacctcagttttgttatctgctcaatgaggataaccacagtacctgactagcagcactgtcataaggaggaaatcaattgatttctgtcaaatgctctgacctatgcccagctacattatgaaatgagtaaataaatcatcaaaatcaataaatttgcaggaaagaggtaagagggaggatcaaatctcccagagaagagccaaagcaaaacatctgctgggagtgggatcacagaggagcctgtaatagacccaggaaagccagtagcaggaggtccctccagcaatcagatgacagacctatttgcctcagtacacagatgccctcacctccagagactcatggtctggtcagagcgcaaggcttggatagaaggcaattggcaatggtgtaagaaaccatccctatgagcccaggtatccgtaaaaagcccaggtatccataaaaatgggatcccggtggcctagaagggtgaggccgggaaactgcttctggaggaggtgagaggagttgggttttgggaactgccgttggcttctggactacctttccttactccttgccagatgcttgcacaggtctccgaaagccaggccctgccagagctagatatgacgttcagcaccacggacagcgcccagcacacctgccagccccgttcagtgggtttagccaggggaaggtggcaacagcttctacactggcatcctcagcttgctggcccctcttcatttccaatcctgctggtcgaagcatctcaagtgatgccttaatatctctgagcatttttactggggctccttggtgactgaaaagtctttattcataaagaccccaaaacacttcacatgtatagagaacttacttgggttttccatgcattacttcatttatccctcacactagcactgtggctgctgttattttacagatgatgatcttgaggctgacagagaagtgtctgccctagactacacagctagtgagggacagacacaagattaggagaagtctctgggactccagagtttgagttcttggggttgtgggtaccctagagggatgtgggaggcagatatgcctttctgacacctttacatcacagtggaaaggcagcctaccacagcaggtgtggcccctgccccagagaaagaagagaagactgcaaagaggatttggggggcccatgctcctgatgctagggctgtctgaggtagaggaagtagcacacctctcaagtgctgaaggcaccctggccatcagcaatcactcggtcacggtcacacatgtcctatagaagggaaaacgaaggctcacaaaggaaggaagagtaacatttccgaagcctcaagctggatgcccaatgctcccttatcatctggccaccccgagaatcactcatgaataaatctcacaatccagggtgtgaatccagggtggtgggtgtaatgccctgacaggaaagcaaggggcagtcaggctcagatatcctggagttggcacgtgcctgaattaggggccctagtctctccaaatccagaggatcctcctccagcccagtgccctttaagttaacaggagtcctggccagcaagacaccaactgggctctgggagccccagcagccccaggcttccagacctgtcttatctcaatccttacttcctacctggaccaatgggtccacccaggcaggcaggtggcctctcagcaggaagaggcaacttataggctgacactggaggggcaggtcccatatgcagaaagaatgggggatggtaaaaagccaagcagcccattacaccgatatctggaaatttcatgttttggtgtgagaggaagttcatagcctcaagggagctgaggaagacatgacaggaggtggctgatactgaactcggggactcaaggacaagactaagggccctctccttccctggaggccaaagaggatgggaagggtgacagaatgaaagtaggaaaagtggaggtcccagctagggatgacctccttcagcctcttcttgtccacacacacccacgcttgcctttgaggacatatgcacatatatacacgcatgcacatgtgcacatgcacagacacgaacatgcgtgcacacacgcacacacacatgcacacccacatgcaataccatgaatacattttttgtaaacacgctcttgccttttgccctcctacatgcatccatttttacacatgcatactttcttgcatacattttggcacaaatgatatccactgggaatcctgtcagctggaagaagaatgtcattgttttgtcattaaaatattttccacctttcaagctagctcttcaactctgaccactgaagcctctgcacagcctgagtcttggttttagctcctaaaacaccatgggttcatggaggacagggaccttgtctcagacacccatgtccctgcagtgctgactgtagcccgtgggtctccacgctttctcccaggtgagcagcacactcagtgccccatctgttaccctctccaactttgcagacagctcccactcagtgccactcccagcaccagacctgcattcttacctgcctgcaaaatgcatccacctggagggcctgctgtctcctacagccaacgactccagagctgaactcagcatcatcctcctcaaagctgaatggcacagtttgcatttcaataatctaggctcaaaacctcccagccatcccttactgctgcctcttacctcccacccacccctacagcaacacccccagcagtcaccatgtctagtctagctgcttccatgatggcttctgcatctgtctctcagctggacccttgccccacctccttcctggtctccagcctccattctcattctctccaactcatatgccctctgggttatctttcccattcccttggttttccagacccagcaaagatcctgacactgaaaacagtgagaatggaggaggatggcagtcaatactttttggacacttaccatttgccaggcactaatctgagtaccttatctggactactttatttaatcttcattaaaaaaaaacccctatgaggtagatactatgattatgcccattttacagatgaggagactgaggtacaaggagttgagagatttgccatatatggtgggccaagtattcaaacccaaagagtctgactccagaggcctgctttctaaccactccacagaaatatcaatctggctggtggtattttattactcccaaactctgtccctccccaagctccttgtctccctcccagctctctctcctgtgctctcttccatggcacctgcatccttaacttcttcactcccagaccccactgcctccccgcttaagtgaaccctagttgtgtcctaaggacatcactcttccaaatccctcatgcctcagaatcaggggtgagtcagcatcctcccctctccctactgctgctacctcctgcctgtggcagaaacgtctacaagatcttttgggtatccttgtcatttgctggccatccttccagcacccatctgccatcctcaaggactttggcaatgctggcacctggttcacaacctcccgttccactccaaatcctgtgattgtcctgggtgacttctactccatatcattgacccagacaacaccttggcctcttggtagcttgccaccctgactctaacaatcccacctcaatggtccattccaaagcacacacttgaccacgtcaccacctccggtgctgcatctctgcagtcctcttgtacaccctgcccttctttcctgccggctcttctattcagttgtgctgcacctgtttttcagagtcctgggaatatccagtctgctgactcctctgatcctctcatcagaaccctcctacatcctcccaaccacccttcaccccagacacgatggtccagctcattcgcctctctaaaaccaacgcctttaactcccatgcccctcctcctggcaccgtcatgaaatcccagccccaggcaaggaccaccatcaacccttttcatgttcacatgggagctgtgtagagaatcccacaacctcagaccagtcctactaaatatccaagtttcttagctcctcatgcctcaatgtcatcatcatggcctcattcacagccctcatctctgtcccctgatccttccaggagaacctagtaaactttcctgcccattccccatagctgctatttcaaattaattcctctctcctcaaagctctgaaaccaccactttttctctcagagtcagcagataacaccactttctacgtcacagagaaaagcaaagccgccagtgtccccttcctctttctgccaccttgaagcatctccccaatcccatctcctcttcccagtcacaggggaatcagcggctcttctacctgcccttttgataccatccccattttcctccccagggaccttaatctacagaagattccctctctctcttccatctgtctctctccactgatcctttcccatcagcttttccttttaagctctctaaacttaaaaaaaaatccctccctgaacccctgctgtcttatctcttaccaagctccttgaaggaggtgtcaccgtccccacactctcgctttcgtgcccctcacccagcgctcctctccactccacttgatcttagccaaaaggccgagaagcgatgctgctctccactcctcagcacgtcaccaatatgcatcctgctgctaaatccaatggtcactttccagtccatttcctccctggcctttagcatcatctggtcctgtagaccattcttacctgcagacagtctcctccttggcttccaaggtggcccactccactgacttttctctgttctcactgcctctcctttcccttcccttgaacggcctcctttccctcggcatgacctttccatgtttttgctccttggggccctcatctcttcccgctctgtgcactctttccaggtgatttcactgactcccatggccttgttattctgctgccttgtaaaccatacccctctcttgaactgtaaacccatgcatccacttgctgactacatgtctacaactggatgtcccacgggaacctcacccttgccatattcagacagagcttcacagcttcctccacactcttgtgctcccagaaaatggtaccaccaggcatccaaaagtatatcccagaaacctcagagctatcctcaactcttctatctcccttgccttccaacacttcatcacactggatccaacgtgtcccatcaacccaccatggggactactccaacagcttcccagctgagctcctggccagtccaggacctcacatacctcagggtcagggctggggccagcaccctcctccaatcgactctccacactttgctaagccccaaatccttctgcgcttcccatcacctcttaagtgaaatccaaattcctcactgttgtccccaaggcctttcctggcctggactctgcctccttctcctgccttgatgctccccattcctctccttgcacactctgctgcagacagactcagcagccttcggtgtccccaacgcatggtgctttctttgcctctgggctttcccacatgctgtcatctctgcctggaactcttctccccacttgtacccacctaccccccttggttcacaggaggcatcacttctcctgggaagccttctttgtatcctaggaaatctggttaactgcccctcacaggcgctgccctggcatagtacttatcatgttataagaaactgtgtgtgtgacagtctaacttgccatcactgactctctgaagtcggcgcagtaccttttatacggtaggtcctcataaatacgtgaatgggtggaaacatacgaatgagtggatgggggatgggtgaacagatgagtgcatgccatgcatgcctcaggagtgcgtgccaaaggctgagtggcagggagcccagcagaagccacatgatgcgggcagccctcagaaacagactccttcccaccaggcttccacaagcctccgacaatcagggaagaacttagcacatccaaacccccaagactcacagcaacagccctcggcaggtggtcccacccagtgctgaggatcatggtggaaaagtgacagaaaaagagcggagacattgaaagtgggggagaaggcaggtgaacagacatgggacagaagaaacagggggcctggggtctctgacaggatgggatgagagagagctggtcgggggaccttgtggctaaagactgccaaccagggccctgactgtgtttccagcctgagctgtgcaggcggtgggagcagaaccaaccacccataataagcctctcattatgggcacacccccttggccctcctctaccccacctccaccacaggggattttagaagttctcccttcttcccaaataggcctagcagtgagactcaggagccctgaggaggggatgaaggaggcaactccactgctctcccggaatcccctccattccccaaccagacagacccaggaggagtcttagggcttcccctactgtgagctccccaagggcagaaatgatttctcttccttttccaagatgggaacacacagttgggcaagggatggggaggaatctcagtaacattatcttattgttaaatggatggatggacagatggatggatggatggatggatggatggatggatggatggatggacggacggacgggagactgttgccagaagaagaaaagactgccaaagataaaacaaaaaaagaattcactaaatcattaacattgatgatttctaagggtgggaatatatcgtgactctgagtttctccatttcacctttctacattttccaccttccccaaaacaggcagatgttacctttataatcagaaacattcatctacctttaaacaatggccagcgccctgtgctgtaaggggtcctctaacatgtgtcaggggaaagacacgatcctggtccccagatggctcctaagtggtcagcagaaatatgtggcaaagtcattgccgtgcccgggaggtcaggatgagaagatgttttggagatcaatgatgaaggtggagagagggtggttgtctgaagagcaggtgtaataggcaaaggaggacagcttaacatcacacgcatgtcagtccatgacacagacacgtgacacgcatgaggatgcctttcctgcctcccctcctcacaccttgataactgtctgaaagcacctattactccccctccacaccccctatctgtctagctcctctttaccattctctgaggcagagccactgtcaccaccttcaccatcccataccctagaaggagctgcctctctggtggtgggggagtgttttgtcccagggtgagcaggagtcctccctgcctgtgtcctggggctggcatcttagcctccccctgtaccctcagggttgaaatcacctcccacagccttcttgagccaggctgggtgctcagctcaggtctctggagggaaatatagccccacccactgcccaaccttcctgcccaacctcccctcactgttgttcttccctgaccccagggtctccccaccacaatagataaattgctgtcttcctcccacccccgcctggccactagggctctatttttaacccacctcaaaaactctgactcagaatcacagggctcccaggtaagctgctcccttgcctgcctagggctgcctcagacacagtccgatttagagccaagggcatctggggcttggtttacaggcgggttgtttggatttgggtgtacatttattttccaatttttctatgtttatcaatatttgaggaacaaagtttgtttcgttttgtttttcttaaaacccaatgatgaccctttacccctgcctcttctaaggtacctccccatcctgggctgaggtcctgcctgtcatgatgcaatgagagctggcctcagcctctccccaagaaggtgagctgtgtgagggcaacagctaacccagtcttctcttcttggcctgtgatccttcagccatacagcacggcgcccctcacacaggaatgtgcacacacatcacctggggactttctgagctgcagacctggtggacttcagtcggctgtggggtggggccaacatctgcactgttaacaagcacccaggtgatgctgagactgctggtgcagggaccacatttctgtgtggccaggctattgtagatgtacggtggctaggtgctctgctgtgaggccttgggcaaatcacttaacctctctgagcctgttttctaatgtgcaggatgagaacattaatccccacctcacaggagtctaggaagaccaaatgagataatatttacaatatgctatatggcataaatactcaattcaagtgggccattatccccatcatcatcatccccatcatcatcatcatcatcatcattctatggccattaagatgcaggtcctggcctgagagctaggaggatcctgagggacacaaatggtcccacctcaagaagccctcaatatagaggatggacagacccaccccacagcggagctgaaaatccaggccagctccatgggcagatggggccatgagccaagggaagggagtaagagggttgatgcagaatctctgactctgtatccctcaggctggggatggccagaggggaggagaaattcagccaggcttgctccagaaaggagcagggggcagcatgccctgttgggtactaaagcctcaaagaggatgcaggcgcccaagtaggtccgctggtcaggagacagcactgtggctagaggccaggggttacaggaaggaggcccatgctatgcgatggaaggtgtctgggtcaggggcctgagattctcaagttctagtcccgtccctgtctctaacttgctatgtgaccttgaataagtcccttcctctcactgtctcttcctcagtttccccattggcacaacacgaggatggagctagacatctctaaagatatgctgagttccatgaatctctgcagtgcagaggctaaagaggtcagccaagggcagctggccagattgacagctcactcacggaagaacgcgcacctcagggaaccctgacacctcagctcccagctctgaagagaatgtggaagacatcctgaacgccagcttgagaactcagggctcttccagggtacatgaggggctgggaaagttatagaggaagagaattccttgagaaagggactgcaaccgcaccttctcaacagcacagtgagaacaggcctgggcaaaagaaacactttgagatgaaaacccattgtttatctgatgggctaattcctcctctgcagaccctatgttgcatatgcagaaacacaccagtgaatatgtacatgcgcacacacacacacacacacaccgccaaactgcacagcaggggacatctgcttcacagtgctccaagttgcccagatgcatgttccctcaggccagggcctaacctctctgtgcttcacccagtggacaagaccactggggaagatgggggaggtaacaagcagttggagaacctctcagtcaagcttacaagaatcaaagaaggctccaacaccactcccccaggaaccttctgtcctcccactcaggagattggagcaaaaatagaacattgttgtggagtagcacgggagcacaccctctggggaaattaggtgggagagctcacctgctcacacaggaaggcactgccagcagcgggaggaaacaggcttgaggggcaacatgaagcactggaaatggatttggggcagaacgtctttgttttttgctttttttttttttttgagatagggtctcactctgtagcccaggctggagtgtggtggtgcaatcttggctcactgcagcctcgacctccctgggctcaagccacgctcctgcttgagtctctggagtggctgggactacaggcacacactaccatgcccagctaatttttctttcttttcttttctttttttttttttttttttgtagaggtagggtctctccatgttgcccaggctggtctttaactcctgggctcgagtgatcctcctgcctcagcctccaaaaatgctgggattacaggagtgagccacagtgcctgacccggggcagaacttcttaaggcaggcagcattggtcatagaaggggctaacaaggaggccataggaaggcttccctataaagagtagctaaatactgactctgcaagggtctacaccacccctttttgatgggatggagcttggggccaaacaacaaggattctctggggcatctggggacacagagctggagggaacgggctgccttctctccaggaaaacacagtctaacaaggaagatgagtggggccatgttctctgaggtcccttctggcctcagaattttatgattttgactcctcacaacccacaaggaaaaaaaaggtataaaagctccctggagagggaggcctattaccaatggggttggatattgtgctaagaaggcaggattttaccccaagctctggggagccaccgtaggactaaggcaaatgcagagcaatcagagaactgcaggctgttagtgcagatgggggcttggggatgcccagctcattggctcccaaagtgatggaggcagaatcacctgagtgcttcctgaaactctacctgcccggcctcacccagggagcccaaacatccatgatcacataagcacccagatgactcttcagcggctgccaattcaggctttgggatcttgctaacacccaacccctctctggtcccattttcagaggaggaaagcaagactcagagaggtgaggcctcagttaagtccacacagctgggcagcacagagccaagtcttctactggtaggattcacaggcttgtcccctagactctgtccccaggagctacagagcaacccaacaggatgatgatgccccagagcctctgggacacgttgaacggcttttcctgtttccttcctctgccaatcccagagtagatgatcccgctggcctgtcccacagggcccctccacccacagtcatctggtgtgccctgcagtctgcatgggtcctcacactctgagctcttctgaggccaggtctgagcttccaggaggggactgctccctaggaggggaggctgggaggagagcgtggttgaggccctttcccggatggcatttcagttcattttcattaagctcctgctgcatcacttcccgggaaggatgccccggaaacaaagaaaagaaagcctggcctccatccacggaggccatgacctaatggagggagggccttcaagaggcctcaccaatatgacacaacgtgccaggaagacccccagccccgctccccaggacaagggccgacaaagcctccacaaaacaaggcccctaggtaagagatcttccacgtgtccctggcccccagggactgcagaactctaggatcatgactggctggacctcggtgacagagccagaaagagggagggagattctcaaaagctctactggtcggcagcactgtccctgccctgctggctctatttgtgctaatggggtcaggattcagggctcaatacctatttggccaattagctctgctctcttcagcctcatactgaggcccgaccctggacactgagagaagagaggagcttgctgaggtcacccagcagaacaggatgagggtcaggaggggaagctgagggtgggagaggtgggcagttctgggcaggctggctcaagatagaggacccagggctctggggcgggccggcccccacactgcaggaagccaggccccaggggcagtctcccctgctggaccaagtttcttctaaaaggtgctaatggcatgaacgggacctgtggacctgagggtctttcctgtctttggggaaaggaacaagtgccctcacatcctctgaagatactggaggtgggagaagcccatggctgactttggcatacagtggctggggactcacattaatcattaacaggggctgctctagcctccaacggggaactgcagggtaattacttctgggctccaggccacacgctcagtgacattattgcaggcaacacctgccttctgggcctagtaaggcaggagaagcgagtcttctcaaaggctgtgcacctaggaccagggtgcacacatacacacaggcaaacacaccacacgtactcagatggcagcacaggcagcccgctcagagtcctcaagggtgaagggcagggactaaggagtacaggttaaaggaggcaggttctgaataagcagcccccagcacctgccaacacccaccccagccaggcggcccttagcttaagcttccaagaaagtgcacagagtggttctctctttccttcagatccagctcagagtcacttgctccaggatgccttccctgaccatcaatccatattgatctattgctcatctgccctcccataaaccagaagtggaaccctactctccattttgccacctccagcacccttaatagtgaaagcagtcttggaatgggtgatatggtattctggagggcatgactcccttagcttgcctctctccaagcccagaggataatgtattagccagcccccattatgtattaatttctgaaagcctcgttcacgcagacataacacatccacccacacagataaatgcttagacagacacaaaatcatcagcagccaattatcaggcccccgcagctgccgtgatcagacctggaggccccgctgcttgctctgcaatttgtggtagcccagagctgggggagcagtgggtggagggagtccccctatccagccggcacggctcgaggtccagccctgaccctgagggcacctgagcttgctgcctggctgagaacaccaaacaccagccccaaacgatgaagagagcagagttgggtggggagctgtcacgtgtgagatttggtggctctggcgtcggcagtggtggctctgttgtttatttataatttgtactttacctcccagagaggaccagaggcagctggctcagatactaagaggtgtaggagctcagggaacttagggagagcttcctaaaggggggcggggcacgaaggtagagtcctgagccttggtacctcagcaagggcaccgaaattggctcaaaggctttgcacaaggatgccagttcctgaccctagaccaaacccttcccttggccacagacttagccctgaccccagccacggactgaaccccaatcctggttacacactgagccccgaccattgtcagaagctgagttctagccatggtcacagaataagccctgattctggtcacacactgagtcctaaaccacagatcaaccccacttcttgacttttctgaagtctagcatgaatagatcacgtgaccatttctctggtggatcagagaaagataccactggacacttgccccttctcctctgaaccccaatcaccgccatccatgaacaggggcattaatggcacccggatatggtccccaaaccccaaaggtctctagcagtcaggacctgcccaggaagaggaggtgagctggcatcccagcccagcatcctcagaaacagcatccccagatctggggtcaggacagcatgtcccagccaccagactctgcatcttcagaaaggggaaggctcccttctcatgggagcagcctaattttgatgggatcctgaaaatatctatcatcccagaaagacaggtatgaagctagagtgacaagaaaaagctccaactgacaggaccattcaggaaaagccttccctgtgaaccctctggctgggaagctgggggtggacttaagcttgaaggcctttgcagacaagacgttacacaacccacttggtctctggtttcgcctctgacatactctgtgaccttgagccagctgctccccctctttgctcctctactccccatctatgaaacaaaggctccaggccagcggcttgctaaggcctctccagatctgatattccgacacctgatccattttctgtgcctgctgactatccctttctgagcccctcctcgacgttttaattctcaggagaatgttttcttgaactacttgtgtaattaaattttttaaacactaacataaaagaaggaggaatgtcaaattccagttctgatattcatggctgcatgatttgggggacctctctctctctctctctcctttcctcgtcggaggcttatctgtaagttggggatataaaactatttggaggccatcgtgaagaataaatgaaatgggagatatagagctcctagcacagcctggcacatggtaggtgctttgtaaatggtggttactgatctgtgaacccacctggctttagtctctgttgatttgagtctagggctataaaatccaaagcctacaggggtcaggcagctaaatggcatgaatgacgtggctgggtgtaagacagtggccttagcgacagctggggacctgcacaactgcagagcaaaagccaatgtaaaggaggcagcctctagtgtctccttcagctccccgctgtggagtgggaatgtggggccagggctgccagggtttccagtttttcaagagaagcccgagagccatattttcatgttgtatctttccatttaaaaacattggctcagatttgttatgacccactatgctggccaaacagagcacatctggatgctgtatttggtgcatgggatgctgcttggcaacctctgatcgaagtactgcccagtcttatcttgagcgcccacggtgacggggagctcaccacctctctgtgctgcctcccacctcagatccgagtgggtgctgatggtacagtgtctcccagtggcttcctagcccttgggactgcagacttctagggccctggcaatgcctcctcagtaaagaagcctagctggcagagaacatcctctccaaagccaacacaatgcccctgcccgcccatggccctctctgtctgggaaacgtgaattcttcagcatcccctgggcgaaagcaagactgtctggccggcctcagtagcccttctattaattagcaactggcagtcgcagctttgtaagagcccttgagccaagtgagtctgtgcaggagccggctgcctcctcggttctaagacaagcccccaggggactggggctggaccttctgctctgagtgaattcctccatggtggtcagtgttgtggcaggcacaagggccactcaggctgctatgacacttgtcagccccatcatttgtatgaaagctaatgcctttcagggtaggagggggcagggagaagtgacaagcaagcccagcccccaggggcggctgctggccatagcctggggcagggaagaaggatataagattgggaagaaggcctggatgcctctgtcctcctctcagctggcccctgtcagagccactggctcccctgctcagtcacctctgcgctcataccgacatctgctcctttccagaaatctcattgcaatgcagcagtcacagtactccctgcgccttctccccagccaggcccacccctctggccctttggatgggagaaaagctgcaaaagtggtgggacaggatggattaatgagggtcctctgaccacccagcttcttcctgttcacacccatcccaaaagccagcatgcgggaccagcagcgtccaagcagcagtgcaggaaaggaggaagagcaagctatgaatcccacatccccacactggcaggcagacctctgtgacttggctcagcccagttcacagacttcaccctgccacgctgagcttggggatagaggccacaggctctgaggccaaagagataaaacggagctctgccctcagggagctcagtttgggagcttgggctaagcatggaacaagcgcatgaacagtaacctcaatactccaagcatggtcctggtctggacaccagccacattagcaatctttgggcgcttaatgagaaatacagcatctcaggccccatccagacctactgaatcagaatctgtattgaacaagatcgccgggtgagtcggatgacattacagcaggacaagctgcattgtaacaaacacagagctccgtccaaatgccacaaggtggtcagccaggaagagatggatggtggccagggtggcctgagagagcatcccacaaggccctggggacactgggccctaaagcatgggagagaagggtggatggacagggagacaggtcagcacagttggaaactccctatgtgaggcaggcagctacctggcagcccaaaaccctcgaagctcacagcagctaagggaaccagtgtggcagggccaagcaggggagaaggtaacccccatccttaccatgtagccaccagaccaggaacttgagccttgcagcagggagaacctggagccgaggcctctctagccaggcagtatggggatcctggccctctgcccctatcgggtttttgtgcacccagcatcctggaagcacctcggtcctgagctccagcagcccctgccttgtcaggtgggacacatctcatccccagagagagccctgctgcccactgtgccagctgatagcacagcccaggcagctcaccttggaattcccctctgcaactaggcacccttccccctccaacacagcctgcggctcctttccgcctggctttgcacactgagagtcctaacaacattcctgggtaatggccccaggaaagcccagcaaagaaggggcctcggaacccccagacccagagtcaggctgctgcctcttcctccttgccacctcctgccagaacagtcctttccaggattcaaagtgagaaaggtgggagcgggtaggactgaggaaatagaaaagaaaccagtcccaagggagaacccctttcccccctcaggcatctaactctgagccctgtttttgtttccatcctgctggcaatgggaggcccaagccccagattgcagagggacccccactgccaggctccagagaaggtgagtgtctgcctctcaccaggcccaggctctcttctgggatggcctagagaggggttcacaaccttgagctcccagatggtcctcaacttagggggccacagacaccagaaattaagtgccacactctatgtgtctggacacccaggtatccttctggatggagtaaaatgtctgaccccaagaaggttcacaacccctgcttgagccaaggacagaggcccttgtgatcttcccaaaaccaaggaaaggaagttgtgaggacaggggaggtgtggttcacaacagcatcacggctcctctgacagctcactgcagcttctcacctcggcagggcgaccacagttgtacaatttgtgcttgacatggcaacaggcaacaagattcccattttctaaatgggaaaactggggctcaaataaggctcataacccacacagggctccacagcagtcagggttggggaggtgatgggaggtgagtaatggcagtgacggggtgccagtgaccagcagcaggaagtcggctcaggacacccctgggacctgctaggccactggcccagtttccaagattttggagcccagctctttctgccccaaggaaaggacactttaagcacccccgtcttcccttcctcatggcttcaggaggctcagtctaggagagggtagggacagggggatgagaaaggccaagcttctgcctgcctccattattaaggctgagccagctttgggggcgcagcagcaatcccagaactgacgttccacacagggacttccccaccagcttccacatccacccacacagcccccagacacccactcagacagacacctagatacacacacccaggctgactccctgagcctgaccagcttccaggaacacaaccagctacatctgcacttggggttccatttcctttctctcctcttagaaaaacaagattagccagtacctatgttttttgttgttgttgttgttccaggttctccaggacacagcttgtgtggaaggaaggacccatccaggacccaagagcccagccagcctcggggaggagcccggggagctatgtcctgaggggctgcagcatcctggcctcttcccttaacacaccacaaatacaagtttcaaaaggcagatggggagttggaggggaggggaagccagaaaagcccagggagcctggggaagccatggcggtggccagggcatggtttcttttctattggggggtgggatcgggggcaggtagagtaatgagaagcagaggtagcccagaaaagcctatgattagccatggcccaggttatgctggtccctcaaagcacagcccacccttgccctggaaaaggcacccagccttcctcccccagcaatgggagatgctggaagcagcccatcacagccagccctgaactccaaaccgcaaactcaatctatcattgtttgctggcaattctttattaaaccagttctgctggatcaatgcttcctgcccgtcaaaatgatgaataaatcctcgactagcctgagcaatgcttgcagaagctcttgcgaagcctgaggtgggcaatggcgattggctacacatagaggcccaaggccaatggctaaaactctagagaccaaggctgggggtgctggtcggggtgcggtgggttaggtggggttgggtggtgggttttcgaagcttagaagaattagctaggctcttgcctgtttgacattctaaggatgacactagctgttttggcctagaagcaggaaaggtatggccaccgctcctccagacacactcagatggtctttcttggatttctttccttacaccccacccagctccagacagctacaaggctgtgcaaagaggacgtgccacttgcagctaccagtccctgttgcttgttgcacaaacccaaattcaaagcccactctgacccttttcctgttgcccatttcacaattctgctgtatccccgcttccctatccccacaccctctcctgcagccatgtcccaggcagcctgcagttagtgggagattctgcagcagggggactgcagacagacataccagaatggggtaagaccaggaaggggaaaaggatcctatctgatgaaatcaacccagtcctcactctccaacttctaaggtaagggagataggaagggccaggcccagcatccagaaggtccccggccaatgcttgctgctgagggaggctgggcatgcctggggttggcctcttgtaggctccccaggcaatgggcttggtgatgagaaccctgaacagatgctttctgacaacaaaaacagcagggacctgggcaagggaggggagggcccttcagcaatctcgaggggttggtactggaactgcctatcaccaccactgaagagttgagagacaggaggaaaaacccaggacacccatgggggtggaggagacatagcccctgctcactcctctctagctcggcccaggatcctcagggcccagtactggccagaggcaagcccactcttcaggaacctggcactgggaacccagacaccgttcctgatgggagggtcccacatttgctcacacaatttgatgactatggctgtctgtttagcctgccctctggtctccctagtcttctgggaatgggaaccctggagatattagggttaggaagagcagtctgtcaaaggaaaaaaggggggaggggctctgttcactacctattttaagccaccgagtgttgtctgactggtcattcccagtgcgagaaatctctctcattggatggaaaatggctttgctctcattacaaacccagcttccctggagtttgcaaagagggctctgggttggcaaaatgctcatttttataggcaggcaactaaggtaggcaaggaagggagataagtaggcggcagggcccagagaaagagagaatgagagaattaaacccagcttgaaaagtgtttcccagaccttcatcacaatctcatgcatcacgaaagcccagaggggcactagggaaccttaggaccttgacttaggtaaaggcatccctgatcccaaccctagaaacaaccaacaatccctctttttgcacaaatatgcccacaagctcccagtggtatctgctgttcagtggcatccgactcaagtgatgtggaagggggcagggtccctctccctgactggcagtcataccttgtttggggacccacgagtggcccatgagagaccaagcagatgctggagcttgggtctctggggtatggatgggccactggacaagcatgggacacaggacagctgctcatcagtcagaacaccaggcatcttcacccatcactatgagcaaggtcattcagccctgccgctctggatgccagctgcccagggtgcctgctcttggcccaccactcagcatgaggagctgagctcagggttacggtgggtgcagggggttttcatcccggcctgaggccccagtgacttcggtcctccagggacccggccgcagcttcccagggcaccagaaagcagacataaatgcctgctgtcagcacccaaggagctggcccgttgctaagaggtctgtctctcttcacggccctgctctgcaggctgaatgacccggagctgcctctaggatggccatcctgactctgcagccttgaagggggaggaggaatatgtggcttaaggtggcagagccctatcctggctgccggcaggggtaggccaggctcagaacaccttttcattctgtctccaatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccccgcccccgcggggaacaatgggcgccggccggagaggctctgcggccgcggcgctcagggaaccgctccggagtgcagagcgcacggcccgcgcgggtcccgggcgtgcgtcccgcgggagggctggctgtccgtctgtctcgccgcccgggctttgtggctggccacccgcgagctcgcctcgcctcctctgccccggcccgtccggcccgtcccggggctcccgccgcaaccgagcggagcccagcgacccgccgggcttacatcagcggccgcctcccccgaagcgccctccggcagcgctcgggctcccgcgccccggaatattcatgaagccgccgcagctcgcgggttgccataggagcggctccagcagccgggcctgcctacctgggcttcttaaaggggcagcggcgcacgggccgggggctggaaaggggcggggggcgggcctggcaaggggcccaggttagaccctcgctagaccttcggggccggggtgagaggtatccacactgctgcgcccttaaatctctttcctgggctaagctgggagtgcgccccaagtctgaagctccggcttcagttgcgaattccccatcctaagattgaagggtggggggtggcttcccaatttctccatcaccaagctctgggctcgcctttccctggcatttttgcccctcagctgggtctccgactttcctcttgggaggcgaccgggttcgtctggatgcagagtcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcgggtgggacccagcccttcgaggtaagacttcgaggaaatgcgccggcaacagtgacggatgcgagatccgaacgccgacctccgcacgcgcctctccctcggtagttccgagaaagggacaagccggctgcagcggggagcggttgggccggttcctcggacgccccagcactctggaactggctttggagccccttctccctgtgttcccatccacattatgacacctactatgtggacccacgctgggtgagttcctgttccacccagtcccctacctgcacccccaagcagctgcacagcccccactcccttccagtctgcagcccagcccccttccccccaacccccgccaaggatccaactgtgtgtcctctctcccagtctctcccagtgtacagtgtccgggcttatggacagatttcactagctcagcctaaggtatagccctaccccctccaacaccatggacagcctgataccccagattagctcagaaatggatagggggacagattgggcattaaggggaggggagttgtccagagaaggctggagccgaggttaatgctggagcggacacacagcaaagtctcacaggagggaggcaaaaaggtcccctggctctgccatctctctgaggaataacatcaagtttttcttcaaatgatttttttactctcattcttagcccaatgtgaccactttcgcctcctccatccagagtaggaatttggagagcaggatgcggggcgggcagcctagcaggggctcttctgctctacccactggaccacaggacctcccacagtgagaggaatgactagggtgatgacatcactggtagctggcatttttacttttgagcagctctgagctgacagttctctgcacagatgctggaagcctaatccctgagtgtccttgggtctccttgagaagaagtgttcttaaagagctgtgagcccagcctgccctggtctaccagccacaggagggaagacctccatttaacacacttctttgagcttctttgtctagctgggagttagtctgccttaaccccgctcaggaagtcagcccatataggcttccccatgacctatggtagagacatctcctcctctgggaaccctttcctaatcaccaaaaccttggtcatgtccctgcctttggttcccatggcccattagctcctgtgaccctgagcactgattacacagtgcagtctgtgccctgagggtggagcaggtccaccttatctcagggacctctccaccaacacaagggtggacagaaagcagattaataagtttcaactctacaaatgagtgagggaccctagaagttagctaatggcattggaggggatgcttggaggagatggaggataagaccaaaattctgcttcctgggatactgctgccacaggccggccaggggtcaggatctcttaattccaccctaccagcacctcactcgccctcaatttcattagtggcacccattcacgaccatctaggaccaactttaggtgcagcaatgactattagataaatcaggcccttgataaaccctgatgagatctggcttctcctgcctcctttatgtggaaaccctaatggaggacactggtggtgtgccaacagtccaggggacagaggaggagcagccccaggtcttgcccttgatgggcttcaagttgtgaggaagctagactcattctcaggaatagggcatgaaaatagagcaggaaaactgaagacaggaaagaaatgtatattaaatcatgtccccaaccatgagagatttcagagggagctattgctggccttggagtagctagggagggtttcctggaggagggggccagacttgatgagagacatatatctaacactttacagtttacacctttttgttgttaaaccacatgaaattttgatttttgtgagcccaatattgtcaaattttggcaatttcacgtgagtcaacctgacattcttactcccatttgcaggcaagagaactaaagcacagagaggtcaagaggcttgccaaatgccccatagcaagaaaatggtgaagctagaattcaagggctccacagggcaggctgtgctctactgcccatctgctcatgcaggtggggtagggggcaggcacagatggaggaaggagaaggagagagaaggtaaagaatggggagagaataaataggactcccacattctgtaatctccccattgctccacctgggtctcacaccctctcctttccagcactgcctagaaggcctggggtctgctctggttcctttgataacatggtagccaggccctggggaccccagcaaggggaaggccctgtctcaggactgaaatatatggagaagacctgctgctctcaccatgggtgggggactaggggactttggagacaaatgggctgctgcagtgctgcagcgggcctggatattcctggaatgcaaatgtagaaaacatctgagtctaagagagaaggggactggggaggatgggtttccttccctggaacggacactgaatatcagtgaaagttagaagacctgctgggagtagaagtggagaatgtagctgattgtataaatcaacctcagaccttatttgtgggggacctagatgggcagagggggatgggaaattctggaagcttatttgcttatgggcagagggcattgttcttgcttggagaggcagctctggggtagggcagtggctcccacagcctgcaatgccaaagttttggccagttctgcttgaaatgagatgaaaacacacacacacacacacacacacacacacacacacacacacacacacacacagaacaatgtaggatattttaggttaaggttgccaactgtcctttcttagaaggctgtctttattctaaggttatatccttgctacattctctgtgttaaaatgcccttttatgaaatcatggtgctggaagatgctgttttttcaatgtcgttggctaaataaaaagttggcactgggttctgtgtttgttccgaaaaatcatttttgaaatgttattgatctataagttccaaaagtctgggaacccctgttgtaaacaatagagcatgaaactgaaaaacaaaagctggagaattaagtacttctctgtcagttactgcctgtgtatgcctcgatcttcctcgtgtgtaaaatgggtttaatgatatgcacctcaaaagttattgctaagactacatgagaaaatgaatgcacctagcatagcatctcatttgtagtaagttctcagtaaacactgaatgatgaaatgatggaatgaaacctgcattacccaatggagaggaaggctcctggcctttggaatccaatttaggtcatatcatcttaaaactttctgttgggatgaaagggatgttttatacaagattccttcctttgaactctccatccctgacaagccctggctgggtctccagaaggcagacttccttctctctgggacaggaccttgctgtggccccaagctctacagcaagcttgttcaacccgcagcccacagaccacatgcagcccaggacagctttgaatgcagcccaacacaaacttgtaaactttcttaaaacattatgagatttttttgcgatttttttagctcatcagctattgttaatgttagtatattttatgtgtggcccaagacaattcttcttcctccagtgtggcccagggaagccaaaagattggacacccctgctatataggcagctgctaactcagagggccacatcgttgaccctgtgctcaaaaccctctgagaaggctgggggtggtggcaagtggtatccatacatacatgccacttcatctttttgctcagtgtagatacagtcctgcacttctgctctgccccaaggcaggtctgctctgtagggctggacagggatcagggacatatagacttcctgctgggagtcctgacctggagacaaggcctccaagaaagaatactggaatcagcaccatgccctcaggttttctgtcctgaggcttcctgataaagaagctggaaaaaaaaaagaaagaaagaaagaaagagagagagggagggagggagggaggcagggggagagagagagagagagagagggagggagggagggagagagagagatagagagagagaaagaaagaaagaaagaaagaaagaaagaaagaaagaaagaaagaaagaaagaaagaaaaagaaactaagaaactggaagggtggaaggggaggggacatgcagggagcaaccagactggatatagatgttccgggaaacaaaccaaccagccagagttgaccaagcccttgggtgcccaaccctgtgcacagctacacatggatggaggccaagaaggcagagatatgccctagcttgggcgatacctggtctggtcaaagcagcaaaagatcatcccagaggtttgtaatcaagagtcaaagggagtggttcagaagctcagggcaatgatcctcttgagtagagtcaagttgggttccctggaggaaatggaaagtggttagtgtgtgtgtgtgtgtgtgtgtgtgtgtgtgtgtgtgtgtgtggatgtgtgcacgcgcacatgcttattatggaggaaagagtgaatggagtagccgggcatggataaggcctgcagcattctcacagtggggtcatcaaggatagagctgggggcaggtgttcaattcacctgcaacagcctttgccctaagctagccctgagagaaagtcctgctgtattatactcagtccttctggtccccctcctcccagtaccctcaaccccagtaggtgacacttgctacaaaaaagcactgggagcccacatgcccatcacatcaaggtgttagtgaacaagagaccccctataggctcaacttcctattgggcttgccatctgctttctcttcagttctgcctggtttctttaggatctaggagcatgagctattgtattgtcctcttctctatcccctgcctctgtgcaggactccacctgtgagcccctggaccccagcagagcccaaagccctttcatctctaggccagccccagctgcattgcccttgatctgtctactccacaccaacccggatgctcgactgttccctggggactctgccagggcactgggtgggacctcttccccctcccacctcggggagcctggaggaagatgtgctgacagctcagccaggtctggactgtgtctctgtgtccttctggggctccaggacgtctgggccacctggactcagagccaggccagagagggaggcactgggagggggaggccctgaggtgccagctgagcagagctgccaagaaataagtaccacagactcctctgttcgaagtctggaattcacgatatatcagggatgaagtgggttcagacaggggcctctggggtggtttcacagcttgggctggaggcgccaggaagggaaagaaggaagagacagaatggactgggagaggggggaagagactctgaaaatggggctgggtgcggtggtagaaagagaggtggtggacagctggagagttggggcttttcctgggaccctgagatggcccagggactggacttggctcagtcccccactaacactgggctcctccgctccacccagccttgcccaggcagtcctccctgccatgccctcagtcctctccccgacttatctatgttttcttcctcccccaatttcacatgatcccttttctctgttcaacgtgtggagtacctgttatctgatgctacatgacccagtccctaatctccaggcatctccaggctatggcaaggataagacagactcaagacttcacataaggaagccagggacgaggagcacgtgatgtggacaagaggctagagggccgaggggggaggaggaaaagcgtgaggagggagcaggggagatgctcatgtctgaagtagttttgatgcaagcaggtgtgacttgtagaagtggaggcagggaggtggggcacgccaggtgcagggcccagtgtgagcaggagagcagcaaagggaagcccctgccctggagtgggtgagcaccctgggagaccacagtcctggggggtcaaggagtggggaacgcgaggacatgagggtgggtggctctggaagccgtgaggaatgctgagggcgactggagacaggcttttgcgaggaccattgggttgtgccctgggagcccagcgctgtgctcagctctgctcagagcgagcaggaaaagaacaagacacagtccctgcccctggaagctcacagtggggtggcgaagatgaaagtaatgctgtgaaacaagtcatcctgccagaagcaggggcctggacccctgactgctacagggacagggactgagcaacagccaggctggagtttaagagagctgctctctctggttccctgcaaagcacatctttgtacaagccccaaggcccagcctccctcccacaagccccatgcctcagggtaacctgctattacatgagccttctgctggatgccttccagaaagagacactccactgtgtaatgagagctgtgccccaggccaccctgcaggatccagagaagaggcagagccagggagagggcaatggagactgccacataatctatgacagatgtggtgacaggggctgtcatggaggctgtgacagagactgcggtgtggactgtgatacacaccgtgacaaggtctgtgatacagactgtgacagggactatgacagaggccgtgatagagactgtgacaggggctgtgacagagactctaacagacgctgtgatagagactgtgacagagactgtgatagaggctgtgatagatactgtgacaggctgtgatagaggctgtgacaggggctgtgacagaggttgtgatagaggctgtgacaggctgtgatagagactgtaatacacactgtgatagaggctgtgatagagactgtgatagagactgtgacagagactgtgacagaggctgtgatagaggctgtgacagaggctgtgacagaggctgtgacagagactgtgatagaggctgtgacagaggctgtgacagagactgtgatagaggctgtgacagaggctgtgacagaggctgtgacagaggctgtggtagaggctgtgacagagactgtgacagaggctgtgacagaggctgtgatagatactgtgacagaggctgtgatagagactgtaatgcagactgtgatagaggctgtgatagaggctgtgatagagactgtgatagaggctgtgacagaggctgtgatagaggctgtgagagaggctgtgacagaggctgtgatagagactgtgatagaggctgtgacagaggctgtgatagagactgtgacaggggctgtgacagaggctgtgatagagactgtgatagaggctgtgacagatgctgtgacagaggctgtgatagaggctgtgatagaggctgtgacagaggctgtgacagagactgtgatagaggctgtggtagaggctgtggtagaggctgtgacagaggctgtgacagagactgtgacagaggctgtgacagaggctgtgatagatactgtgacagaggctgtgatagagactgtaatacagactgtgatagaggctgtgatagaggctgtgatagagactgtgatagaggctgtgatacagactgtgacagaggctgtgatagaggctgtgacagagactgtgacagaggccgtgacagaggctgtgatagaggctgtgacagagactgtgatagaggctgtgacagaggctgtgacagaggttgtgatagaggctgtgacagaggctgtgacagaggctgtgatagaggctgtgacagaggctgtgacagaggctgtgacagagactgtgatagaggctgtgacagaggctgtgatagaggctgtgacagaggctgtgacagaggctgtgacagaggctgtgatagagactgtgacaggggctgcgacagaggctgtgatagaggctgcgacagaggccgtgatagaggctgtgatagaggctgtgacagaggctgtgatagaggctgtgacagaggctgtgacagaggctgtgatagaggctgtgacagaggctgtgatagaggctgtgacagaggctgtgacagagactgtgacagggactgtgacagaggctgtgagagaggctgtgacagaggctgtgacagaggctgtgatagagactgtgacaggggctgtgacagaggctgtgacagaggctgtgacagaggctgtgatagaggctgtgacagaggctgtgacagagactgcaacagagactgtgagagaggctgtgacagaggctgtgatagaggctgtgacaggggctgtgacagagactgtgatagaggctgtgacaggggctgtgatagaggctgtgacagaggctgtgacaagggctgtgacaagggctgtgacagagactctgacagcgactgtaacaggaattgtgacaggggctgtgacagaggctgtgttagaggctgggacagagactctgacagggacagggacaggcactgcgatggggactgggacagaaatgtgactaaatctggaaccacaatcagagttgggacaacagttcctggagcccgggcccacactcccacggtcgacagagcagttggcggtgacagcagcaacacagcaaacacagaggcccagccaggcccaggcatttgtggggacgccagcaggctgaagctgccgcgggaagacagcgagagggaggtgagtgaggctggcgcccacccagctctgcctcggatgtctgtgtgtccacaggcgagttcctggccctctctgggcctcagtttccttgatagtgcttaccatggggacagatcagattagagtgtggtaagtgcaaacgtgcactgactgagggtcccaagttactctcaggggtctctgaatctccagagtctccccaggcacagccagctgattgaatccgtaatgcgcctcccacacatatgaacaaccatctaccccatgtgtgcagtgctcttgtgaagaacgaaacacaaatttgttttaaaatgtaagataattcatagtcatgatcgtaactaacatttatggagcacttgctctgcgcaaggtaccacaccaaatacttagcatggattagctcatgtaatcctcactagagctctgtcaggtaagtggtattttccccattttacagatgattaaactgaggcttaaagaggctgaccgagttgcccaagttcccaaggctagaggaagagccagggtttgaagacacttctgtctgacccagtctgggctcctatcctcactcaccatgagcaactctcttaatcacaactgctattgtgtcagatacacttgaagttcaaagtcaaaaatgttttcattgaaaaaggggtcttcacacttgaattggctgggacctaccgggaagcgttccttcagtgcgtgggcacttctggtatttctggaactctatcttctctctgcccctgcctgaggcactaagttggggataagcaggatatgattttctgccctaagagagcacagaatagctgtaacgatttcaaggactgtgtttgtttttgcaccttgtgctcaggatctcactttgagctgtgcagagaaggccctcacaccctgctgtccttgagggttggatcctcattctcccagatgctccttggtttggaagtgaggtggggacccccatggctcctcccagaccatcactcttctaccttcccataaaactcctcacccagccgggcgcagtggctcatgcctgtaattccagcactttgggaggccaaggcaggcggatcacctaaggtcaggacttcaagaccagcctggccaacatggtgaaaccttgtctctactaaaaatacagaaattagctgggcatggtggtgggcacctgtaatcccagctactcaggaggctgaggcaggagaatcacttgaacctgggaggcagaggttgcagtgagccactgcactccggccactgcactctagcctgggggacagagcgagactcaatctcaaaaaatcaaacaaacaaacaaaatccctcttcacccacctgctcctcagaggctcccacagctggtcccctcatggctgtcaccaaggcatctttcccactgaatttccgccttcatggagggggctccccatgaaccttggccctggcttctgatttcagtggccttcttctcacccccagccatccactcccatggcctcaacctagagatgctctacctctacgatttaggctgacctcagcctctgctccttccacctgctctccgggccctccctttacacctgctcatcaagggcagtgagagctgcaaaagaactctcagcacataatgactccacctgaacccttgcacccagagacttaataaaactctagcatcgtttctaacagctcaaagcagcatcactagatgatgactccagtgctttaaagtccctgcctgggaaagctcaagatggccaaaagaatttattgtttgttccagtcgagggcccctgtctcccagtctctgtgggagggcacttaactttgataagtgccagtcaccaaacctagcttgcctggtcatatagagcaaactcctgtttttgcccttcaatgcctgttgcctggctcatcccactttaaaaaaaaagccttttggcctttgttttgaagaagttgagttcagttcatgctgaacccttttccctattgcaatagttatcattgaataaaatctgtccttaccattttaactagtgtctaggtttgtttacctttgacaatagcaagttctgtgcatccgccccttccgccttcagtcccttcccttcccagtttagataccaatatctaccaccacaagcttatcttgccagtgtcctcaatttctttgcctcttggttctttttgtctgtcaacctagaaactccagctctgaccttctctgcaggcacaccagctacagcaggcctgagaggcagccagagaaaatcacatagccgcacagatttgttcattgtctctgatgtgcctctatgcctggcaatctgactgtgttttccttatctgccatgtcttcattctgttccatcagtgtctgagtctgcacagtgttgctatgacagaataccacagactgggtaatttataaagaaaagagatttagttggctcatggttctgggggttgggaagtccaagagcatggcactagcatctggtaagggtcatcctgtggtggagggctggagggcaaaggcaagcatgtgaaacagagaggaaggggaccaaacatatcaggagcccaatcctgcaataatggcattaatccattcgtgagggagtagctcctatgacctaatcacctcttagaggccccaccttttaatacaatggcaattaagtttccaacacacaaacttcagggggacacattcaaacaatagcaaccagttaacacttctccccaaatctcagccttctgatcaaatctctgctatccaaaaaaaaaaaaaaagtgtcctccttgaacttcactgtccctttctctccttcccatcacatctaaacctctcaagagggtgggcttcatttgctttcctttctcaactcccactcattcctcagcccatgcagtcaggcttcactacccatggtgtcttcagcaagaccacaaatgtcctcctgagtacaaagtccacctttttttcctttccttattgaccttggagcaccatgccatgctgctgaccacctcccccttcttgaaatacccccttcccttgacttcagggacacacactcttctgattttctttctacatctctggccagttctcaggatcttttgtgtcccatcctcttctactggctcctcacatgtgggtgatatccctgactctattgtatgctctttttttcccccacggggtctctctccctgaacgccagacccttggcttcagttgccattcatgccttcagcccagacctctcctgtgggctccagacctgcttatttggcttcttggatgtgttacaagcagcacacactgaaaatgtctaaacattcacactcttctccaaagacccctgctcttcctgctcaatgaacgagaccaccatcatccggtggctgaagccagaaacactggcattattcctgactccttcctctgccccaacatcccatcagttcaaaagtcttatttctccttcataaatatctctcaaatatgtccacttcttaccatatgcactgacacaacttcagatgatttcttgcctaggctatggcaacagcctcctaactggcctctctgcctccagccttgctctactataatccattatccatgatgctaccagagtggtttttcaaatgtaaatctagccatatctgcttaaaactcctaacaaatatcactggccttaggataaagtccaaactccactggcaaataagcggctcggtggtctggctgctgttgctccctcagccttccctccaaccagtgccctcctgaccactgcactgtgtgctcatgcatgtccatgggctttctgctggtggtgatggtggcgatgtcattcatggcagtggaagcgatcagatgtcagttgttggtgattatggtggtaactttaaaccactgcccatcacattttcaaggcgatctttggaggctgacttcatccaacaaatattcctcgctcctatttcctgcagggttaattatgcatgcccatctcagatccacctccatccaggactgttttagggctctctgtttggggccctggcgagctcccacattgactcttggttatcagcctgaacctatgtccagcgttcatctctttctggccttcagttgagcccagcatgttggtgatgggacagtgatggcgataaacatgaagatcctgctgctatcagcactcactggggagacagacaaagttgcctggggaccctaggagaggagccactgggaggtccagccaggtggtgctggttccaagtcctgctgcgtccagcagtgatcagctgatggggctgctttgaccttctcagaggtttggctctgaaacactgaccttcaccgactttctctgtatacccagggctgatggtctgacccccaacacagggcacttggttgccaggctggagccctgacacttctgatacagacaacatctcttcccaataccagcatttatttgcatctatgaatatgcatggaggctgttttcctgaactggggaaggtagctgggagctgggaagactggatataagctgtctggggggtgatcacaaggcactgatctgcccctgtggtaggcagaatgacgggccccaaagataaccaggtcctaattcctggaacctatgaatgttactttgcctgacaaaaaaatatataaaagtttgccaaggtgattaaggatcttgagatgggaagattatcctggattatctgggtaggccctctgcaatcactggtgtccttataagagggagacagagggaggtttgacccagaacaagaagacaaagtacccacaaaagcatgatgatgcgctgagggctttgaagatggaggaaggggccatgagccaaggaatgcaaaggaaaacatctagaagtgggaagatacaaggaaacagattccgcactggagcctctggagggagcgtggctctgccaacaccttgatttcagcccagtgaaactgatttcaggcttctgacctccagaactataagagaataaatgtgtgttcttttatgccaccaagtttgtggcactttgttacagcagcaataggaaactaatacagtccccttccaccctccctctctgtcactcctcacttcctcttgagttgggttaagctgtgggtaagcagggtagctgagcgctgagtggtagagaagacagtcctcctcacctctccttggggcctggcaccctctggttccattgaatggtggctttggaaacattggaaggtgacacctcctcagagcagtagtcacacatgggtcactgtcagagtgacatgctcaggctacttccagtggctttgctggcagtaggtgttgagctggggcagagaggaaggattctagagaagccatatggggatcgtggctgacagagcgatgcttaagcatatgtgtgctcccttttttggaactcccagaaatacttgtggcagaggaggaagagggcagaggtcctgtaggcgcaagaagagaaacagcaggaactttgagttatggatgttaatggagctttatttatagccacagactgggagggtctgataacatttgtgtgatgttgctcctctcgctggctactcccccactgccttttcgcataggtggctgattaagcaaacaacgatgtccaaatgctttcatcccctttccctgttttcattcagtctccatctttttcttattgagttgaaggagcactttctgtactggggagagtattcccttctctatcacgtattgctacaaatacccatttcccctagtttcttatttcctttaacttttgttatgcggtgtttgccatgcagaagttttcttttttatagtaaagtataaaactaaaaagtaaaaaaagtatttttttttaatttatttatttttgagacagggtctcgctctgtcacccaggctggagtgcagtggcaccatctcggctcactgcaaggtccgcctcccgggttcacaccattctcctgcctcagcctccctagtagctgggactacgggcactcgccaccacccccagctaattttttgtatttttagtagagacagggtttcaccatgttagccaggatgttctcaatctcctaacctcctgatctgcccgcctcggcctcccaaagtgctgggattacaggcatgagccaccgcgcccggctgtaaaaaagtatttttacgatcaaacaatgccttttgatagtaaagtatatcaacatttccttttaccatctctgacttagataacacatttaaagagctcttccccatctcaagaaatactcacttaaattttctttctataaataaatgtttatatacatatataatccatatttctcccattaattagcaatgcctcctttcatcatatactaaatttctatacatacatggttatatatttctggattttatctctgttccatcgatttgcttctctattcttgttcctataccactctgcccccccaaattactgtaacatatattatctttaaataataagaggagtctctctcctgtgatacttatctcattcagaattctttcctgggtttcttaccagattaactatctagttaaaataatttgatcatattttaaaagatcataggctgggcaaggtggctcatgcccgtaatctcagcactttgggaggctgaggcaggcagatcacgaggtcaagagatcaagatcatcctggccagcgggattcccagagtcttcagatttgccctgaattgagggtgaaggcagggataatgggtgaagctgtgggtgtgggtgaaattcagaaggagattgaatactaaacaagaggaactgaaggtggaagaccgttggcatgtgtggggaaagtgaatgctgcgaatgtggataagagaaagcacacagaggggagaggtgagacaccagcagacgggtgtcaaataagccggaggaggaggaaagctcaagaccagcatagtcgacagagtgccatgttgcagggcggagggcggttgcagagaatgactgcaatggagctgtgggctgtgttggtcgtggctgattagcgatgaggtggttataacatttagtgtttaaactgggactgttggagaagactctgagacaacaggggtaaagcaggattcttcctggaaaactgagacacatggtaaccccagttagtggtgacctctgagaaagtggtctcgttggagggatggccaaggtgcctaggttacatgggttgatggtacactgtgctttgtagaagtttggcccaaaagataaggaaagagttggtggtagatggaggggaatcaaggttgaaaggggtgggtgtatttacttgtctgttttctaggcttgagagatttgtccatctagggaagggtaaggacttagtaaaaagggagagatagaagatacaagatatagaagggataattaacaaagagagaagatacaggagggcaagggcaagatcagcagtgtataaaggacatggggttaacctggaagaggaggacagttcctgataagaaggaaataaaagaatgcatggcaaatggaggaaagttgaggtgcagaaaagggaatttgagagaactaataatttctcaggaatggctgctgagaaggaggtgggcaatctctttggagtaaagagcccccaaaggaaaggagtagaagcctttaacccctttctttcagtaattaacacggctagattccctctaatggattgagatggttctgaatgagacccattagtggtagggacctggccagggtctaagctcagtgccaggcccaggctctaagctggtagggttctggctggtgtgtctgggctggaagcctctcccatcctaggcactttggcacattgggggtcttcctccattgaagaaggaccacaatccctgtagaaatctggaccagtgagaacatcactgtctcggtgggcaaggatgctcggactgtgcagggccaggttctactgtgacaccttggggtggcagcagaagccacagtgagtcggaggctccagcgctctcctcacctggctttggatggaggaaccagcccttcggattcaggaagtcctccaattcagggtggaggaagcccccaagagacagacactggatttcttgttacttcagacaggctcaaatggttaatatgaaatattagtctaatttataacccaatttcagtataatagaatggtatgcagccattcaaatatgttggaaaataacgtttgattacatgaaaaaaatattcaggaatattcatagaacaactagtatgaacacaataatctgatttttgaaaagaatatgtaatatatctatatagagacagatataagactgtaagaatatatgcaagttagcagtggttgtttctgggtgatggaattatgagaattatgagtgatttttcttttgacttacctttattttctacaaggtgcttatatggctttttagtaagttaaataacaaagtcattttttcaaaggattgccaagcagtaacaggaccccagctgagccgggagggggaatctgttgagaagccagtgcctgagcccgggttactctccccagctgcactcagcaggtacagctcatgactgtgtaaactgaagggaaaaacaacgtggccaaatttagcaatgcacctagcccatgggacacttccagggggagctgccctgcattccccacctggggctctgtagaccacctttgagctggcgacttcaatccagatggcatcggttacactttcgcccttctcttgactctgcacacaactatcctcagcccatctgtacccaaggccaaatgggagagatgaaggtgtaaaccaaaagtgactgagacaggtttccatcgagtaaaggtttatttagccaaggttaaggacaggccatgcgggctgtaggtagagggtgggagggaaggtagggaaattcaagccacaggagcatctgtgacccatgctttttccaaagggagtttttgggaactttcatatttaaagggggaagagcaaacaggagggaaaaaagagggagtgagggtaggccgtgaggcagatgattacggtcttgtgaggctctgattcaccccagtaaatctacattttacatgtgaaagagagcagaagaaaaagtcaatgatgctttatcctgcgctgagtaaatctgcatttgacataagagaaagtaaacatgtgaaaggagggagcagaggaaatgaggctctgacagggttgtgaaatcactgctgcctgtttgggaacaaaaggaaagcagttcttgtgtgactcagttccccagcttaacttcccctttggcatacagagtttggggtcttgagatctattttctttcacaagggtttaggaaggctgaaataagcaaggggttctcagaaggaatggactacggtggctacagctgtgattccggttatgtgcctgtcaaggtcaccgcgctgcacaaaactgtggtttttccaccctctggtgggaagaggggcaaggacactgccagccagtagggaaaggcgcaaatcagaccagaacccagcatctagagggaaggccttacagctctagccagagtccttgatgagtcctagacagcatccacccagggggcacggtcagctcgctcatcctggccggggctagtggcccatcctgagtgtcactgagaggggcccatgatacctcccacctatatttggtggatgtgtgcaagggggtcgctgaggggtgtggacaggtctccactggagggtgcggaaggggctgagcactagccctttcggctctttccagatccctgaatcagatatcaccacctgccccatgggaagcctgttagccagccggatctctctgcttagcacacagggctgtctctctcccaggagcaaggcctttgccaaacagcaggaggggtgagatggggcaggtgaagagggaggggcctcccctggcccacccccatgcctacgtgaagattctctaagtgaagcgccatccctggtacctaccactctcttgaagattcccacaatgatggtgaaggaaacgcagtttatctctgactcataacaggcattccataaatatttgttgaatgaacaagtaagtgagtgaagtaattaattgattttgtgggcacatggctagataaggagacagactctttttagacgagggacatatagataaaaatacccatggtgcctggccatgagtaaaagaaaggctaagttgccaaggtttgttgactatgagtcaaaatttttatgtattaatcatgatactttaaaaagtcttacattgaggccgggtgtggtggctcacgcctgcaatcccagcattttgggaggcagaggtgggctgatcacctgaggtcaggagttcaagaccagcctggccaacatggtgaaaccctgtctctactaaaaatacaaaaattagttgggtgtggtggcatacacctgtaatcccagctacttgggaggctgaggcaggggaattgcttgaacctgggaggcagacattgcagcgagccaggattgtgccactgcactctagcctgggagacagagcaagactctgtctcaaaaaaataaaataaaaaataaataaaattttaaaaataaaattaaaataaaaaggcttatattgggactagaaccacagagtatcaagtccaaccaagtccaagtttcagataagaaaacaggcctggaaggagaagggagtgtccaaagccacagctggtagaatttaagcaaactgcaggcctcttgcttcccggtcctgcaggggtcttgtgcctcatgctacttctgcaatgcagctgggggccttttccccaggtgcagggtgtatgtgatcagttttccttataaataaatattggttgggcatctactggatgcaatgtacctattatatgccaagcaagttgctagatactggtggtagaatggtggaccagatattaacttgacaggaaaggagatgggcgattaatctggcaatttcaataaggaaagtacacccagctttgggagcccaaaaaaggaatgcctagcccagacctagggtgaagggtcaggtgggagaagcttgaggtggagagcagacattccacacaggagcctttccaggggcattccctcaccctgctcccccaacccccgcattcctggctgatctgtctcctacttgcctgggagtgcctggctccagagtcccaggcactgcagataagagtcacacctcagaggccaaggggacaaatatgcaggacaggctgctcagatagagggagcctcaggaaggggtcaggctccagagggaggccctgggaaggaaaagctcttcggggggatgtggtgggatggtatgaactcaaaggcagaggcctgacctgcaggcccctctcagcaggcccttcccagccctgttgagttttgctcttcaaccatgaatctcagtcttatttggaggccaaagcttctctaggagaaggagacccctcatctttctggtctcctttccacctccctcctcccatctgccgatgggacaacttcatagacaactcacccctcttgcctcatcagcccatcctgagtcatttctttcatccctcttcattggatggctcctgaaactcaatctcttccagagaagtgtggaggcagagtcagaagtggagagagagagaaacaaccatgatcctcctcctctccatcatcctagtcctagtagttgggctaacatagacaggagcctatgtatcggtcagaaaccctgcaggaaatggaagcaggagagctgtgagttagcatgttgctgaggggcaaagtcctaagagaaagagggcaaagaaactccatctccttccccactggatgtgctggttaaaatcatcagctaaggtaggtctggcttctctgagatttcattgctactcctgattggcctgaggcagcccctgggcacttttcatgcttcttgatgaggagttcttaactgggctactggggttccatgcatggctccaggaggtctctggagcccccaaacttgtatgcaatacactgcatatttgcacgtgtccttgtttctagaaggctcacaggttccatcggattcccaaaggtgtccatgacacataaacggtacagaacccctcatccaggtctttggaggaagacacacctcctgctcacctgccctctcccgaaaggctcccctcccctcctctgggtttcttccactcttgtgcttctgtagacagcctgttcccagagccaactggggccatgtgcttctctgctcacctggacacagcaccacgcctctatcgactgccctatttaggagctgctgagctgacagcagaaaccaggactgcatttgccccctccagaggcatctaggctttgaggaagggtgtgggcgaagagcctctgaatctctggacttaaggagcaggagttctggagtcaaaaagacttgcacttcaccctggatctgtgccaccttgacaatttaatgaacctccctgagattctgtttcctcatctataaaatggggtgaatgcctccccacaggggtgttttgaggattgaggtaatggctataaaatgccaggcactcaataaatattagctgttatctggcataattggacccagaaattttctctccagtgtccctggctggaggttgtccagctctttctgggagctgccacctcccaaggcaacccagccccatttggacagctcccactgtgagaaacttcttacgtcagttgggaactctgagttgaagtgacagaaattcaactcactggctcaccaaaatagggaatgtattgggccaagaaattgggaagggtagcagcagaagtgacctcaaggactctggagacctaaacaatgttgtcaggacttttcttctctctccctgaaactcttggctctgtttctccgtgtgattggcacaaagtcaccaacaattcccagcatatctcatcccagcttggagaaccagaagatagagaatctttctcccagtgatcacacatacattctcagggaggattgagagaggccaggcgtggatcacatgcccatctctgagccaattaccatggacagggccatgggcgcttatgactggccaggtgttgtcccacgacctgaggctaggagatcgtatacactgagtggtagccacgttgaaaccatatggagtgtgggagggtaggttccccaaagaaaggaatgctgtttctagaagcctgggcaaacaaaacaagtggttgttcactgctctttttcaaattcagtccagcaccagtcctggctctgtccttctggcctacacaggacaaaatatgaagagtcattgtaacctcctcagtcttcatttctccaagctaagttcttccctctctctgaatacaatgggtttccagtgccccctccccagactcctgggcagaaggcagcagtctggttggaagttggaatggggactggatttgagaattatcaactgaaatgctgatgaaaatgatggggggctctagtatgccttggaggcagccactgatctggtgtttcctttagccaccaggggagttgacttgggaggaaggagaagtggtggtgagtgggaggaagagaaggggaaagaggaggaaggagagaagagagaagagtgggaggagcagggaggcagacgaagagggagaaataggagttaatgagaggaatgggaagaaagcttcagctctcaggctgggaagcacaatcaatacatcaaaaggtgcccagtgtgggccgggcacagtggctcaagcctgtaatcccagtactttgggaggccaaggtgggcagatcacttgaagtcaggagtttgagaccagcctggccaatatggtgaaaccctgtctctactaaaaatataaaaattagccgcgcatggtggcatacgcctgtaatcccagctactcaggagcctgaggcaggagaattgcttgaacctgggaggtggaaattgcagtgagccaagattgcaccactgcactccagcctgggcaacaagagcaagactccgagaaagaaagaaaagaaagaaagaaaggaaggaaggaaggaaggaaggaaggaaggaaggaaggaaggaaggaaggaaggaagagaaagaaagaaagaaagaaagagaaagaaagaaagaaaaaggaaggaaggaaggagagaaagaagagagagagagaagggagggagggaaggaaggaaggaaagaaggaaggaaggaaggagggaaggaagatgcagactatgtgcagaaggagctcgcggctgggaaccatgccccaggtgatcagggcaggtgtgttagtttgtttccactgctacaacaaactactacagactaggcagcttataaacaacagaagttcatacctcacagttctgggggctggaaagtgcaagatcagggtgccaccatggtcaagttctggcgagagctcttttccagtttgcagactgccaacgtctagctgtgtcctcacctggcaggagaggcaggcaagctccctagggcctcttctataaggacaccagtcccaatcactaagcctctgccctcatgacctaatcacctcccaaagcctcaccctaatactatcgcaatggggattcagtttcatcttatgaattttgaaggacaaacagtcagactatagcagcaggcttcctggaagagggagcttgaaggaagaagaggagtgcaaagctagagcctggctctgggaacccacagcaggaagcataggagcatctctgatggcccagctggagagtcgggggcaggctggcaagagaaggggcttctgcctccctccctccattcttcctttcccaattgggctgctctgcagaggtcacccctaggctaatgaggaatcttcctgaagtttaaaaccaattaagcaacaaatggtttctgattagttatttctcttgatgtgaattttaatgaacagcttcctctccccgccctaccttccaagcaccctgggagctagccagctttgggtctgccttgaagagccctcaggggtgtctcagaaggctgggagaggaaggggagagggactgggatgggggggatggtgagcaggtttgcacagcacagcaaaccctaccagtcagcctgcatttcccttgacattgcagggtgccgcttgtccctgaggcaggggctgtctcgaggggaatgaggagcagggagaggacagaaagcaagtggaacagagagatggtgacagcgactaggtgacagcctagtcaaacaggctgaagtagaaagtataaaaagttcacccaggacaaaagctagaagagctggaggaagcccaagctgcagggaggcacagaggtgggaccagggctacaggggaaggcagagtggtgcagtaagcagaaccaagttctatggggatgtgctgtggggctctcagtggatgggccccccactctggtgctcatccttccacgaatgctgagatggtggttatcattggccttcctctagggacacttatgacccttccatgagatgacgcaagggaaaggacactgggagtagggtaatgagtgtgggggagatggcagggcactgtcttctccacccctcaacaggagactccccgcacaacagctgttggaccttattcagttacacccctgtctcattccacgggcagcaaacgggggccagagtcctcagctgtgtctccattgcggacaggagggccagctgcacagtcacagggtccagctctctctaccctaaaatgagcatcctctaggatccttgcccaggactgagacacccctcgggagtagctgagacccagaagtgctgctcggaagctttgtggaatcttgctgatcagccctgcactcctgaccactccttccagctgagcagaaaagctttcttgaaaggagaatgaagtccagatctctgctggaagaaggaaagagggtgggggaagcaccttgtaggaactgctgacaaagaaataaggatggatttttctgcaggttcctcttcactgttcccctcctctccccctcctccccagtccctctacctcccaccttttcttccctccctaatccatgttggctctgagggacatctggcagaaggtttctggaatgatctgactaggctctggacttccaggaaaagcccagtggttcttatagtgattccctcagggtcagaggaaaggcaacatttctggcccaggcatctgagtgatgacaaattgagagcagccacctctaaacccaacctctttggcttctgttttgggtaccaggagccagcctggcccaaaagattggctcctgaccagggctctgcagcccagaactggggccagctgctccaggcctgagcctcccccacacttggcctcatgtcaccatcaggcacctgggcccctctggttggcttgactgccccagctttctggaacatgctggctgtgtcttcctcatggagcagtgacagatgacagattggactgattaggtctcttggtggcaagggacagaacccaattatgggtacaaaaaagaactttattggtagataatagtagtaccaggttgtcctttttgaggagccggccagagtcaggtatggggtactggcaaacacatcccaactagaagaagggttgaacagtcaatctagggaagagcagggctgctgctggatcccaggaacatctgaactcaagacttttttttttttcttttgagacggagtctcgctctattgcccaggctggagtgcagtggcatgatttcggctcactgcaaactccgcctctcggattccagtgattctcctgcctcagtctccctagtagcttggattacagacatgtgccaccacacctagctaatttttgtattttcagtagagacggggtttcaccatattggccaggctgttctcaaactcctgacctcaagtgatctacccgcctaggcctccaaaaatgctgggattataggcatgagccaccacgcccagctgagctccagtcttgaatgttgccaggaacctgtcttcttccttccgcctatatcccttgtctctgctcctctctgactgtagatcagcttcagatgcctcctgagcctcatccctcacagcttcagttcctaatgagaaatggactcatctcagtagcagctcaaaaaaatcccagggaggaagtcaatgggttcagcttgggtagaggccctgcccctggatcagtccatgattaactgaggatagagtaaaatggctctttccacgggaaccctgtaggtggaaaggaggaagaagcagcttactagaagaaaggggcctctccccagaatttgagaggagggctggagagacaaatcagtaagcctctatttcatctgctgtctcaccaagaggactgtgggactttttttgcaagtcccgctagagaagctttgtgagtgtgactctcatcatctctggctctcaagggggcacactgctagatgtatttctttccctcatccccagctccccgccggccaatcctgacccagagactgttctcatttgtcaccccagactctggccctggtgacccacacctgccatcttgtcctgcattctctctctctttttttttttttttttttttttttttgagatggaattttgctcttgtcgcccaggctggagcgcaatggtgcaatctcagctcactgcaacctccgcctcctgggttcaagtgattctcctgcctcagcctccggagtagctgggattacaggtacgcaccaccatgtccagctaatttctgtatttttgatagagacagggtttcaccatgttggccaggctggtcttgaattccagacttcaggtgatccgcctgcctcggcctcccaaagtgctggtattacaggcgtgagccaccatgcctggcctcgtcctgcattctcttgtcttggtcagctttacttagtggttgaaatagagcccaaagataagatcccaggatttggagtcaggtgtccctgggcttaaaagtgccaccatttatgacctgtctgagatcctgtttcttcacttgtaaaacggaaaagagtacctaaccgacagggttgtaatgagggttaaaagagacgggtggccggacgcagtggctcatgcctgtaatcccagcagtttgggaggccaaggtgggccgatcacttgaggctggaagtttgagaccagcctggccaacaaagtgaaaccccgtctctactaaaaatacaaaaactagcctggcgtggtggggcgtgcctgtaatcccatctactcgggaggcagaggcacgagaatcacttgaacctgggaggtggaggttgcaatgagctgcgatcgtacccattgcactccagcctgggcaacaaagcaagactccatctcaaaaaaaagagagagagagatggggaatataagctcttggcacatagtaggcactcaataaatggcagcctgaaaaattcctcatcaaaacatatagagtctccacggctcctttgtcaaacagcaagatccctgtatttgagcaggagctatttgtagcaggtgggggaagggcggtgaggatcgtcttcctgctgcaggctgaaggagaaaacctcagtctcccctccccagctaagctcacatatataccttttggccaactctggggagctgtctgttttctgggaaaatgtctccgtggcttcagggaaaaggtcagctacactggagtgcatcacaagagcagagtggagagggagatgaagaccctgcaagggaccctggacatatctatcctggggaaactccagcttctaaatgtttcaggccgtagggaaaacccagacactgggtccctcagggccacggtctgcatctgtgcccaaatcagccttgtgtatctgcacaggctgtccttcctgaggagctggctgtgactggtacaggatattggcaaacacatgtcagctttactcccccttgtttgggtcggcaaccctgagctgcaggctggtgggcctagcagtgatagggaggggcaggggaaaaatagggaacaaggacaacccaagatacaggtacatgcatgcaagcaccctcagacacacaccagccggccctgtgtgtagagggaaacagatggccaggatcagaagccctacctgaggcctcccagatgtttaataatagtaatcgagcctgcatttacaaagcacttaccatgggccaggcactgggataacctcttccagttcattatttcgttaaatcctttccagaatccctggaagtgggcagtagtacccctgttttacacatgagggactggaagcccaaagagttaagtaacttgctaaagaccacatcatctgatttcaaagccctgtcatcctgctgcccacatgggtactacaacagacccagttttcctacgaagacattcacagaggacagaagattctccaggcaaatgcactggttcttgcaggcaggcctggagtggcccagtgttagaatctcctggggaagttgctgaaagtgcaacttcctgggttccactcccccttcaggcaccctttcttctccatactgattcaatggggttgagggcctaggaatatgcattttaacaagctgcctatctcccatgaaaatagcttcccgccccattattaaaaatatatactgtctgtaatcccagcactttgggagaccgaggcggggtggatcatgaggtcaggagatcgagaccatcctggctaacaaggtgaaaccccgtctctactaaaaatacaaaaaattagccgggcgtggtggcgggcttatatactgtctgggcatggtggctcacgcctgtaatcccagcactttgagaggccaaggtgggtggatcacctgaggccaggagttcaagaccagcctggccaacatggcgaaaccccgtctctactaaaaatacaaaaattagccaggcatggtggctcatgcctgtagtcccagttactcagtagactgaggcaggagaattgctcaaacccgggaggtggaggttgcagtgagctgagatcgcgccattgcactccagcctggacaacagagcaagactccgtgaaaaaaccaaaccaaaccaaaccaaaccaaaacaaaaaacatatatatactgtttatcgtaagatctttgactcccaattgctacacatggggctcaggtgcaaatctacatttttcatatatttgtgggaaagaactaggttcactaacgttggaaatgtctgctcaggattttgaacacatggcctggcccggaatgcagttgctgggcttccccaggtcagtgtcagtcccagggatctgcacagaggaagctgggaactccacagtctggagtgtgggaggagggtgcatcccctccagctttctcctggctccctaggctcctgcaacccctatcgactcagcctcacaagcaggggtggaggaggcagcaagcactgcttggagtaggcaactctaccaggccttctccgtccacaggagaatgcatcaataacttctgcaaaagcctctttcctctgcccaggaccctctctcttggaagcctgggaccatccttggttccctacttcctaagctcctcccacaccattctgccagacttgtaaagctcctcttccaagaatgtcctcccctgggtaattggacccacaggccattgacatttaaagaaatgttcctgaccttttcagcagttccataaaatcgcaaaataggtctctaaatattactgcagactcctacttgcccagaccctggcagagactcattttcccggctaactcaggaataagagaaaaatagcaatattgctagcaaaaagagggctattctcaaacatcttttggtaatcattccgttatagatggctgttatctgcatcaggactccaccatcaccacccaccaccaccattacacatttcgccatcatcaccttaattacttgattatataaaatgtgcaggatttgtgctcttaaatcttcacagtgcaaaaagtctacttgcgttttagctatttgatccagctatgtgagaacgtttatcttcttctccccttcctccattggtgtgggaccagatggaacaatggatatagaaggaccaaaggctatggagagagacataagagaagacagaactctgggaggaggggcagtgaatgtgtaaagagacattctgagaaatttgaaaatagattagatattagatcaggactatcccttgcattaacagagcttgggttaagagtagaaatttacattttcctcccacatgtttcccaaaacagccttatcacttaaaacaggagttgggcaaactccactctgcaggccaaatgcagcctttggctttttgtacgactcttgagctaaaaatgttttcactttttttttttttttttgagatggagtcttgctctgttgcccaggctggagtggagtggtgcaatctcggctcactgcaacctccaccttccaggttcaagcaattctccctgcctcagcctcctaagtagctgggattacaggcacacgctaccatactcagctaatttttgtatttttagtagagacgggtttttgccatgttggccaggctggtctcaaactcctgacctcgggtgattcacctgccttggcctcccaaagtgctaggattacaggcgtgagccactgcacccggcccacttttttaaaatatacaattcagtggttttcagaatattcacagaattgtgcaaccatcaccacaatctaatcctggaacacttttcatcaccccaaaatgaaacatgacccattagcaatcacttcccattctcctagcccccagtccctcaaaaccacaaatctactttctgtctctatgaatttgctttttctcgacatttcatataaataaaatcatataatatatgacctgttatatccaaatttttttacttagcataatgttttcaaggttattcatgttgtagcatatactatatataagtaatatttcattgtatggctatatgtgtagtactttctgataacactctggcaccaaatgtgttttttttcactgacaccaaatacctgctgtttttccacaccaacaaccaattctccagcatgactctgtgtcctacaattcaattcagttctaacactaactatccagagttagcacagaccccacaggttaagggctcagtcccacaagagtgctcccacttcaggtgtcagccataaatggggttccaaggctactaacacttctgtccgtctgactccaaattcgtgaccccacccccaccccgaccctcaggttcagtaattctctagaataactcacagaactcaggaaagtgctttacttacaattattggtgtattataaaggatacaaatgaatagccaaatggaagagatgcgtagggcaagggatgtggggtggggcacagagcttccatgccctccttggacacaccaccctccagaagctcgttgttcaagagtttttataactcaatctccagctcccctgctcttcctggagatagggaagggggttaggggagggcattgaaagttcccatcctctaatcacatgttgggtctttctgatgaccagcatcctgaagctatcaaggggctccaccatgagtcaccccattaacaaaactaaaatgtatgccagcgctgggcgcggtggctcacacctataatcccagcactttgggaggccaaggtgggtggattacctgaggttaggaattcgagactagcctggccaacgtggtgaagccccgtctctaataaaaatacaaaaattagcctggcgtggtggcacatgcctgtaatcccagctacccgggaggctgaggcaggagaatcgctcgaacctggaaggtggaggttgcagtgagctgagatcagctgttgcactccagcctgggtgacagagcgagactctgtctcaaaaataaataaataaataaaaatgtatgccaggccccgtggtgtgcacctgtagtcccagctacttgggaggcctcatgaggcaggaagattgcttgagtccagtttgaaaccagccccagccaaaatagcaaaacaccatctcaatgcccccacccaaaacaaaacacaaaaaaacctcaggtgtagtcaaaggggcttgaaatgaataactagatgctcctatcactcaggaaactcccagagtttcaggagctctgggccaggaactgcagacaaagatcaaatacattttttattataccacaatgtaccacattttgtttatccactcatcagttggtggacatttaggttgtttctactttagggctattacgaataatgctgctatgaatatacatgtacaggtttttgtgtgaacacatgttcttaattctcttgggtgtatacctaggcgtggaattgctgggtcgtgggtttcaccatgtgatgaaccgccaagcttttttttcaaagaggctgtaccttctatattcccaccagcaatgtgtgatgctttcaatttctccacatccttgctaacacttgttattgtctgtctttcttactttaaccatcctagtggctatgaagtggtatctcattgtggttggtattaacatttttaaaggattgtaaaaacaaacaaacacacaaaaaaatatagcacagagactgtatgccatacatggtctgcaaaacctcaaatatttactacgtggacccttacagaaaatgtttgaaatattcttaattacccattgaattaaaaggcaaaatacaaataataaggaatgattatcaaaagtttaaatccaaattatttgactaaagctgaaatttttacttttaaaaaatttaattacatcttaagtatttttattaaaaataatcacaatgttagcatttattgtctatcttttttttttttgaaacagtgtctcactctgtcacccaagttggagcgtagtggcatgatctcggctcactgcaaccttcgcctcctgggttcaagcgattcccctgcctcagcctcccaagtagctgggattacaggcgtgtgccaccacacctgactaaattttgtatttttagtagagacagggttttaccatgttggccaggctggtcttgaacttctgacctcaggtgatccaccggccttggcctcccaaagtgctgggattacaggcatgagccacagcacccggcctcatttattgtctatctaattgctaatgtaaagaatcagcattatacttcagggacaggacatctagatctagcagatacaaatttaaaagtagtatgaattgtttacttttgcaaaatgttcctcagttaccatatacagctattgcaaattttttgctaattcactagtgtgcccagaactctgaactagaatatgaagagaagcaaggaaatggtctcttggcactactgaggcagacatttatcatgcaagaatgtactgcattcacatcacactctctaagaggaatgatttgacaagttaattaatttgtctttctctgcttaagtgcttctgctgctaaaatccacaggctcccagaagtggacccatctctaacctcaaaaactgcccagctctgatgcttactcagtatttggaggcaggcacctcttactcagaggctggtggggcattgggggaacaagagcatttcccagaggcctgaatggtgtgagtcacaagagtagatgttaggctatgggtcatttgtgctagggctgtatgcttaatccagggtgatagaggtacccacatattctttaatacttatgtatttatttatttatttgttggtgttagaaatatgtaagaaccttggccaggtgtgatggcgcacccctatagtcccagctactcagcaggctaaggtgggagaattgcttgagcttcaggagttcgagaccagcctgggtgacatagcaaaaccctgtctctaaaatatatttatattatttatttatatatataaatgtatataaatatatatattatatattatataaatatattttataatatataatataaatatattttatattatatatataatatatataaaatataaaatatacatatatatatatgaacctctaaagaatggggtctggcccaggtctaagagtaatactgtattactgtgttggtaagatgttgagggattactctttattttgttagatgtgataatagtgttatggtaattttattttatttcgagacagagttttgctcttgtttcccaggctagagtgcaatggcacgatctcggttcaccacaacctctgcctcccgggttcaagtgattctcctgcctcagcctcctgagtagctgggattacaggcatgcaccaccatgcccagctaattttgtatttttagtagagatggggtttctccacgttggtcaagctgatctcgcactcccgacctcaggtcatccgtccgccttgacctcccaaagtgttgggattacaggcgtgagccaccgcgcccggcccggtaattggaaaaagtcatctgttaacactgaagtatttatgaatgaaataaaatgacatctgggattggctttacaatactgcagacaaaaaaggaaaacatcaggaagatttatgaaataagattggcaagtattaatattaataactcgtgaaactgggagatgatctatcacccagttcattttaccattttcttgactttttgtatgtttaaaatttttcatactacaaagttaaaaataatgaaatgaaaaaagacagaggactgtgggggaaggggaggtacagtgagcgaatgagggagagaatcctgcttcctgggacggcggccacattcttctctctgacagtgaaggaagaaggaaggacgcccaggaagcaggctgcagcccacatgtaagaacctttactagcaaccagatccatgaaaatggagtgatagcatttgggctggaagtaaaggactaatgaaaccttctccagctgacagtatggctattttggtatggactgttccaaccctcccttctgtaaggaagcattcctggaataatgaaagagttcttgagacagacagctgacctccaaggtagctcttttccatatcatttttaaagttaggagatagttcaggcaccaaaaaaaggtatatgtgaccagcccagccaacatggtgaaaccacatctctactaaaaatacaattgttagctgggcgtggtggcgtatgcctgtaattccagctactcgggaggctgaggcaggagaatcactggaacccaggagatggagcttgcagtgagctgagatagcaccactgcactccagcttgggtgacagagtgagaccctatctcaaaaacaaaaaaagtttatgtatgtacctatcactcaccttgtcaaatcttagcattttgccacctttgcttccaacctttaaaaacaaattttttaattttaatttttgtgagtacatggtaggtgtatatatttatgggatgcatgaaatgttttgatataggcatgcaatgtgtattaattgcatcatgtagaatgggatatctattatatcaagcatttatcctttgtgtcacaatccaatcatactctttcagttatttttaagtgtacaattaaattgttattcactacagttactctattgtgctatcaaatactaggtcttgctcattttttctgctttttggtacccattaagcaaccccactttcccccaaccttccctatccttcccagcctctggccaccattcttctactctctatctccatcagttcaattgttttgatttttagatcccacaaataagtgaaaacatgtgatgtgtctttctgtgtctggcttatttcacttaacataatgacctccagttccatccatcttgttgtaaataacagaatctcattcttttttatggctgaatagtactccattgtgcgaagtaccacattttctttatccattcagcttctgacccttttatttataaattgaaataaaatattacagatagagttgaagcccttgtaaaccagtctgcaattctcttctctttgccctcagagataacaactagcttgaatttggtgttcatcattcctacccaaactacatgtataggtatctatcaataatatatagcattgtgttgcctatttttaaactttatataaattgtatcatacttaagtgccccataattttattttttcactcacattttttgaatatttatctgtgttgatcctaattatatcacaattgatttattcattcattctcttattgatggacattcaggttgattacaatatttttctattgtaaactatactgacatgaaaattttgtacatgttttctcatgtataagtatgacagttcctatttagctggtagtaattaattgttgatttctagtgtatataatcttatatttagtagctcctccccaaattggttgtatgagagtccatgtggcaccacagttattaatttttgccagtctgttgagtgtgaaatggtatatcatattctcttaattttgcatatctgactgcttatgcagctgtgcagtttttctcccttactggccacttagattttccttttctgtgaattccttgtttgaccatattttctcctttgcattgttagttttttcctcaatgcttcatagttctttatatattctacatactgaccctttgtaggtttaatgcagtgcatagatcatctcccaatcaataacttgatttctcaattgtgatttttttgtacaaacttttttttttttgagacaaagtctcactctgttgcccaggctggcgtgtagaggcgcgatctcagctcactgcaacctctgcctcctgggttcaagtgattctcctgcctcagcctcctgagtggctgggataacaggcacgcaccaccccatctggctaatttttgtatttttgaagagacaggctttcgccatgttggcagggctggtcttgaactcctgacctcaagtgatccgcccaccttggcctcccaaagtgctgggattacaggcgtgagccaccgtgcctgacctatacaaactttttatttttaatgtagttgaatttattttccattgttgttgatgtttttttttcttaatttaagacatcctttcctactccaaggtcatatgaatatgctcttatattttcctctaaaaggttttaagttttgctttttcataattaggtcttcaatctgtccagaatttattttgtgtgtggcatgagctacagatctaactttttatgtgtgaataaccaatgttttcaacatttcttacttctgactcaaaattctacctctatcatgtatcagacatccatatagacttagacatgtttgtggcctctctacccattaggtttttctatttgtcaatgtttattccaatatcacactcccttagctaccatagctttatatgagattttaatatctggctgggaagtctctcctcctatcatcttcaaaattgtgttggctgtttttaattcttcactgttccatatgaacgttaggatcaaatttttcatttccacaaaaaccctattgcccaaaactatactgatttcatatattaatttggagataactgccatagttacaattttgggtttcatcacatatgaaactaagagatatataaaatccacacttacttagatctgttttaaaatcttctaatagtgttgtataattttctccattaaattttctcctgggatatgttggttgggtttattcttagtgaacttaagctttgttttgttttgctattttgacagtattttaaattatattttacaagtatttcttgttgccatatatgaatgcaattaatgttttcaccttctcctactctttgttttaataattttactatagattattttggatttttctatgcattgttgtacaaataatgatggtttactttatttccaatacattttttgacatctttgtactaattgatttatgctttaatagagatatgtatgggttttgtttgtttgtttgtttgagatggaattttgctcttgttgcccaggctggagtgcaatggcacaatctcggctcactgcaacctctgcctcccaggttcaagccattctcttgcctcagcctcccgagtagctgggattacagacgccccctcaccacgcccagctgatttttgtatttttagtagaaacagggtttcaccgtgatggccaggctggtcttgatctcttgacctcagatgatccacctgcctcagcctcccaaagtgctgggattacagatgtgagccattgcacccagcctgtttttgtttgtttgtttgtttgtttaccagtatctttttttttcctagcatggctaggctctcccttagcttattgaaaagaagcgccattgtcttattctggcctttaaagggaataggaagatgctaatagtattttatttttatttttttttatgaatggatattgaatcaactgcattttctgcatctctgaaggtctcctttagtgtgttgatgtttctgagttttggcatcagcttgtagggcaggctggatttatctagagaggctgtcgcagagtggccaccgctactggtagaaccgggtgcatttgctctatgtcctgctgagtcagaatccctggtgatggcaatcaggccccagtaaggcagtgtccttaggctttgcagctgcttctccagtgagccattttccctctcactcagaaaaatgggagaatttctttgaggaacattcacacaagcagaagactctcatctgggagtcttcctgcaagtggaggatgctactatgtcatgggagcatctacctctgagacattagggaaacttgagttggaggaaagctagaatggcacaagagtggtgtcgaaagataggatgactgtgatgggtaaatcagtagcccaccaagaacagcagtgcatgagaggtagggaggactggcaatggacagcaaaagatgcaagaacagtattaaccacatagggctaaggaccaggccccagggatctaagtatgactcagtagtgggggaaaaggaacatagcactggcatggaaggtcagggctgctttagatgttaaagggccagggttctcagagctgatctattttggcctacaaagataatgtgaaattcctacaactgagggatcatggctgtcattcatacctctatatgggcacaaatttttatgtcctttcttcacctagaacccagcttaatacacaaaaagtattgtacctttccaatatttgttaaatgagtatttgttgactgtcgaacccacacacaaaacaattagcacagggcctgtcacacagtgatgtggaaaccataatgctggctctgagtgttggttggagagatgctgggtgaatagaggccttcatggacttacaacccaagtctcagacagacagtgtctccctgaccaagcctggaatgagagagcagaatgacagtacctctagcctccctcctcttcactggccccctctctaaagtgcagtggagccagacagaagaaaaatgacccaagcatgtcaactcacagaggctgctccccttggtatgtcttcctcagctcatcgttgtctgtctacttcactaagagaatgggacacatatgagcatgtggtctgctttactccttccccaggagctgtctgcatgcctgtcagaatttatatttgcaaaaccatcagtgatcagaaaatactatggttgattctctgtccttgctgcctccaacagaaccacaggaaaggtacaggttccatcttttcctccctccccttctattatccatctcctctcctctccatgtccctactgcaaaaattggcctctcaatctccattctaccttctcttagttagaggcattgaaaagctacacactaggtttctggattcaaagcagcttttaccaaataaacagtcaggtggcatttggaagtaagaagtgagaagaagaccatcttcctgctgttgctgataaacaaagtaaagagtacgaaggctgtggcagcatctggactcagagttccaatgtctagtgtcttgctttgtgggatgagggtcagctgtggtgttcacagaggtagtagcagtagtgggttcctaacagtttcagtggtataattatgtatttgatagcctggttgcagaaccttgacttccacatcacaaatttcttccaaaaattttttgtattacatccctttccgcataaaataattagagtgatttctgcttacttcagtaaactgattgatgcatctatcctctgctgggtcacctaaatagataacagtttgcccaggagggaattcagtttcggttcaggtcaacccagttagtactgacctccactatatgcctagttcattttctaggcttttgccttcaggaagttcctagtctgtctgggtaaatggactcacacaaaagggtctgtaatcatagatactatttattgaacaatcaccaagcaccaaggtactattgggactttacatttgctgtctttctcatcataaccctgtacgtatgtgtatcaagaatgcttttggtcataagcattagaaaatcctatcacatacttaaacaagtaaggggtttatttttctcacataaacagatgttcaggctaggaaattcagaactgtatggcttgccgaagccattatgaagaactgggcttcttttatctacctgccttaccatcgttagtgtgtttttacttctacaatagaatagaatagaacagactagaatagaatagatgctgtacctccagacatgtcatccaagttcaaggcagaaaggaagatgattgaggaaggcaaaaagcaaatagcaggctgggcatggtggctcatacctgtaatctcagcactttgggaggctgaggcaggtggattgcttgaggccaaaagttcaagaccagcctggccaacatggtgaaaccccatctctactaaaaatacaaaaattaaccttgcatggtggcacatgtctgtagttccagctacttgagagtgggaggctgagtgaggcacaaaaattgcttgaacccaggaggcagaggttgccatgagccaagatcgcaccactgcactccagcctgggtgacagagtgagaccctgcctcaaaaaaaaaaaaaaaaaaaaaaaaaagcaaatagcaacattcagtaacctcttccttgtcagacattgactttttattctggaatggaaggcctccctggggtcttctgtctgcatctgattagttagagctgtgtggtatcatggccacctttttctacaacagagagtggagatgtgagcatgtcacttgccagccttttttaaagtaagacagtagacaatatggttgaaatagaggctaaatcatctaatctacagaatctgccaaggcaagtgttatctcagttttacagatgaggaatctaaggttgagagaagtcacacgatgtgcctgaattagctaagggaatgtggaccacagataatacggtcgtctgtcctgtggagcatctatgcactgcactgaggtgaaggggtgcttttcctcagtgtccatcagagtctccttggcctcaatgcctgctacagatgtcccctgatcttggacgaggagtgtagacttggggaagtatagagtttttgacaccattaaacctagagattgagaaacctaccttaacatgttaggagcatttctagagctgaagcactaccatggggatgtacaggctactgtgagaagacaggactcaagggaagtttccacagcaagaaccaccaactcatgaaggccacttgccagcaatttgtgtggcaccagcagggaacatcagggctaacagggagctgtgttcactgttaggttgttatagaggtgagtagtaacatttgagatagcttaaaaaagaaatggtgaacaggcttaggaaggtaaaggtagaggtctctgtccccttgaattggtgtaggcttgaagagaaagtggaattgtggacagggagatctgggtgaatggtggcaccagagagaagcactgagaaggtcctgagggcagtggctgctgtggatggtctaatttcaagatctcaataaaggtaactataaaattggagagatttaaagaaggccaaaaaaaaaaaaaaaatgaggtaccatgttcatggatcagaagccaatattgtaaatatgtaaaatgtctctaaattgatcaatagactcaatacagtctcaattaaaatcacaagattcttctaggaaacaaatgagcagattctaaaatttatatggaaatgtaaaaggtaaagcttatccaaggtagaagaagaggtaagaggacttgttctagcagatatcaggatttactatgaagtagagtaactaagtcagtgtggtattggtacaaagataaaaaattaaaccattgaactgatggaatagaatagaggatctagaaataaattgcgcatagacagacagtcgatatatgacaaaaaaacaacgctgtacactgggaaaagattgtctttctaataagaggttatcaatgtggaaaaaaatgactcttattccataccatcaacaaaaatcaaatttcagatggatcggaaaattctcaatagattggagtcctaaaaattaaagacagaatagtaagaaatgtataagagaagataggggaatattttcatgaccttaggataggtaaagatttcataagatgcacaacagtaccaaccgtaaaaaagaagattgttctacattaagacctttgtttttagttaagagctttgttcaaaagataccagtaagagagtaaaaagataagccatggaatgaggcaagatgtgttccacacatataaccgacaagaaagagcacctagaaatcaataagaaaaagacaacataatttaaataatggttaagtaattgaacagacacatcacaaaaagggaagtccaaatggtgaatacatttaaggaaagtggttcaattttattaattaaggaaaagtacaagattctattacatacccatcagatgggtaaagttttccttaaacatctggcagcactaggcattggctagggtgtagtgcaaggggaactctcttatactgttgatgggagtgtcaattggcataaccatcttggaaaaatggcatttgttactaaagtttaagatatgcatactcataccataacccagaaattcctgtacaagaatgtacatgggcaagaatgttcatagcagtattgtccacaatagcctcaaactagaaacaatccacatgtccatcaaccatagtttatttattcatataatagattatatggcaacaaaaatgaacccagctacgtgcagcaacataaacaaatctcacaaacacaattttgagcaaagaagtcatatacaaaagaataaacactacatgattccatctatatgatatttaagaaatcagcagccaaactacctagcctagacttgcatacttaggtaggatgtgactactattattttcagcatagtgtattcctcttggggaggaagagggctgtgactaggaagaggcaactgggggtgcttcagtggtgctagaaataatctctttctggctgggcacggtggctcacacctgtaatcccagcactttgggaggccgggaggctgagaagccgaggtgggtggatcaagaggtcattagttcaagaccattctggctaacacagtgaaaccccatctctactaaaaatacaaaaaaaaaaaaaaaaattaaccaggcatggtgggacacacctgtagtcccagctactcgggaggctgaggcaggagaatagcttgaatccaggaggcagaagttgcagtgagccaagatcgtgccactacactccagcctgggcgacagagtgagagtcctccatctcaaaataataataataataataataataataataataatgtctttcttgaactgtgctgattacccaggtggtcagtaagaaggattaaactctacattcatctggaaccatcagttttatgtactttcctgggtataatattgcagaataaaaagatgaaatataatatatattagatctggaaataaattcaagagtccctctggtttaggtccactccaacaagcagatcagacgtcctttatccccattttcaggtgaggcaattgaatttgagagctttaaatgacttgtccgaagccattcaatggtaacgaatcgaaaccagaaatagaacccaggcctcctgcctcccaggttaagactctttccggtctactttgcatttctctcaacccaaacagcagtagttaagttcacaaagagttaagcaacatcattgagggaagaatttcccaggtggcctggatcatcctggatcctggcctccttttccccagggtcccagccctaccttgatgacccaggcagtgtgaggagctgggactggagggttaaccctgaagcctccaacagctgcctgggtgcatctgaggctttgcattgctcttatttccctgttctgctccacatttcctggctggcccttctggacctacaagccctggctgatgtgaccagctctttgagatttgtatgttttattgcctctcagtcaagaagagaactacctaaaagatatacagtttgagctctgtgagggcaagaaccatatgggcacaggcactatactccaagagaggtggagctgaataaaggtctggttccttatccaaggaagtcggtgaccaatccatggactttgtaagtcattgatggttggggaagggagagatcaatgtgggctaactggtccaagaggtcacatttgtagtgagtcttcagtgataaatggaaattgatacatgaaaaaagaatggaggatgttccagcatgggaaacttcaggccagttttgagaagggtgatcaagttgaccacagcaaatcattcatgtgggagtgtaaggtttgatcagtttgtttcactgccctttcagttacagcattctgcagggcttgtcatcaaacttgtgaagctattttgtggcccatggctcttcctcatcacagtggaggctcctgcagggcaggcctatgcctcccctatggggctcagccagagcgccatgctctgcagctttgccaaatccccttctgaccatcaggctatcagcagtgttcctcccgtgaccatctgggttccaggtgatgcttctcccagacgttctggtttgcattttttacaggttgaagtaagtgcattatttcattctggctgtcccacagccccaacccttatgcagttgtcccccctggtcccccatatttttagcaaccaatgtaattaatatgctgtgtaatgtgttttcctggaactatgattatgctcaaggtatctcaaacctttttacagtaattactgagaaaaagcttggagagtattaaccatgcatgtggagtgagctgtaatctgaccttggacacttagatattaaaaatctctctgactgtgtctgccttcatttgcatttccaaattttcaggttagagggcctttcagttgattgaataatgggttaatggaatcctctttctaattaaatccagattgtctctttgtgaaattgcacacttgacagtctatctggatcattctaattgcattctaaagttgccatgggggctgtcttgaagaagctactgtcctgtctgagggtagaaactgcacacaggagagtagcaggtccaggaacactcagaggctatccagttccacacagtgctgtaatataagatttgggagaacagggacccactttgccttgttgaccatcatgtatgctgtgcctagagcaattatggccactgttctcaatgctaggctcttgatactggataactattgcttgaacacatgaatgaatgaatgatttgcagctgtgttgtcatactgacaacccagtggggcgggctgaatggccacttggatgtagttttaatcccatgttttaaattatgggactaggatatattgaacccagagcatgagaagattctgaatacaggagaagctaggcttgagcaattcccatatctccccaatatatgcccccataatgagccttctgcagggactgggtggcccatttctttaacaaactctatgacttgctaatagccatctaatttcaaatttctatgacagttatgccatatgataaaaactttaatatgaaatgttcttctaataccaatcctagctaatctaaaacatactgcttcctctagccatggatttctatgcttaattctaatcttttttttttttttttttttttttttgagacagagtcttgctctgtcgcccagactagagtgcagtggcacaatctcagctcactgcaacctccatctcccaagttcaagcgattttcatgtctcagcctcctgagtagctgggattacaggcacgcaccaccaggcccagctaatttttgtgtttttagtacagacagggtttcaccgtgttgaacaggctggtctcgaactcctgacctcaagtgatctgcccaccttggcctcccaaagtgctgggattacaggtgtgagccaccacacctggccaattctaatcttttaaaaactcaatattaatccttgattgcagagaaagtagtggggaaagtattctgggtctgcctattacaaacagtaatataaccagcttttttttttttttttttttaaatgcgtggttggctgggtgtggtggctcacacctgtaatcccagcactttgagaggctgggcaggcagatcacttgagcccaggagttcaagaccagcctgggcaacatggtgaaaccccatctgtacaaaaaatattaaagaaaactagccaggcatggtgtctcacacctgtagttccagctactcaagaggctgaggtggaaggattgcttgagctcaggaggtagaggctgcagtaagccctgtttgcaccactgtactccagcctgagcaaaagattgagaccctgtcttaaataaacaaataaataaaaattaaaaaataaagtgcatggttaagcttataagaaagaaaagtgaatctttcattggccaccaggaaaattaaaacctaaaccactatgagataccatgttacacccattaggataggtgtaataatttaaaaaaaaaaccataaaataaccaaccttggtgagggtgtgaagaaattgaaacctttctacatgactggtaataatgtaaaattgttttttaaaaaaaaaactccaggccaggtatggtgcctcatgcctgtaatcctagcactttgggaggccgaggaggacaggtcacttgaggtcaggagttttgagactagcctggccaacatggtgaaaccctgtctcaactaaatatacaaaaattagccaagtgtggtggcaggcacctgtaatcccagttactccggaggctgaggcaggataatcacttgaatctggaatgcagaagttgcggtgagccgagatcttgccattgaacttcagcctgggcaacagagagagactctctcaaaaaaattttttttaactccaaaaagttttttttttcttttcctttttttttttttttgagacagggtctttgcactattgcccaggccggaacacagtggtatggtcatggatcactacagcctcaacctcaccaggttcaagtgatcctcccacatcagtctcccaagcaacggggtctacacgcgtgagccaccatcccttgctaagttttgtatttttggtagagatggggtttcaccatgttgcccaggctggttttgaactcttgggctcaagaaatccacccaccttggtctcccaaagtgctgggattatagacgtgagccaccatgcctggcccaaaaagttaaacatagtattatcatatgatccaacaattccacacaagagaattaaaaacttgtacataaacatttataacagcattatttatacagttggttctccatatccacaggtcccacatccttggattcagccaactgtggctgaataaaaaagtatttttggggctgggcatggtgactcacgcctgtaatcccagcactttgggaagccgaggtgggtggatcacaaggtcaggagatcgagaccatcctggccaacgtggtgaaaccccatctctactaaaaacacaaaaattagctgggcatggtggagcatgcctgtaatcccacctactcaggaggctgaggcaggagaatcccttgaaccagggagtcggagtttgcagtgagccgagatcgcaccactgcactccagcctggtgacagagtgagactccatctcaaaaaatatatatgtatgtatatttttaagaaatatatatttttaaaaacaataatacaacaataaaaataatacaaataaaaaacaacacagaactaccatttacatagcatttacattgcattaggtattataagtaatctacagatgatttaaagtatgcaggaggatgtacacaggttatatgcaaatagtgtgtcattttatgtcagagacttgagcatgtggattttggtacgggtgggtatcttggaaccaatcccccttggatatcgaaggacaagtgtaatagtgcatatcttggtataaacaacccaagtgtttatcaactgatgcatggataaataaaaggtaatatagccatacaatggaatattaatacacttatcccaggccacttttccctccacaaaagttgatggccagatatcctacatagagctctgccttccaggaggatcacagccatgggtggagtcataggggggcggcagaccatttttgacgcacagcaacaaatcaaggcattccattcatggaccagacccagttttttcctgctcacagtagctggttgtatggaactctccacgaggccttaggtttgagctgagacaaaggtattggtacaacagaggtgggcggcatggggatttgggatacctgacagtgtaaattatttgagctcttcagttttatttgggcctaatctcaaacataccgattccaccatatgatggattgctactgtgttctcaaatttgtgacttggtggatgtgacaggacccaacttataaggttagctccactcaaacagtcacctagcaccccatggtcatgcactcagtttcagccagggttctggtctaccagggactgatgtttaaataatggctatctctctgctgcaggtagcaaatcctttctccaggaccttagggatttgtgctatgactctcctaaaataatttttcagagatgccacatagcacccttatctatcacaggtacctatagccccattgtgctggattatatgacctccccaccctctgccccatggcagggctgcttttgctgaagcctggacctgctgaagagctcacttttaccctaggcccaattcaaaatcagctgccttccaatgcatctgataaatgggactgaataatattcccaaccatggtatgtgctatttccaaaattcaaagagagcttccaagtactctgccactttttcagtgctaggaggtacaaggtacaatcgtttgtcttttacttgaagatattccagcataccccagaccactgggcccctgaaaacctcactggtatggtattctccctaaatttttatgggatttatctgttaccctctggccctcaagtgtcttgccagggcttccagaatacttatcatttcctccttaccaagtctgactaatgtgatttaatcaatatggtaaaccagcatgaagttcttcagaatatcaagataatcaaggtccctttagactatattgtaacggggagcaggagagttaatcaagctctaggcaagacaagtgaatgtgtacagctctgtgtcttaggtaaatgcaaactactactaacctcctttcctaatggaggttaaaaataacacattcaccagcttaatagatgcagactcagtatcatacactgtgttgatctagtcagtaaagatagcaaatttcatatagtagctgggattgggactaccacttgcttaaatttatgggaatccaccatcatttgtcttggtcaatctgatttgtaggtccttaagaaagaatggtggtaatctctgctattccacccagtatgcagtacaactacttctaatttactatcttggttggtaggaggaatagtttaaggggcttctgtctggcctttcatactacaatgactcttaccccacaggccagggaaccaactactaagtgtatctatctcaataatgcaatcgggactgagaaaattgacttataccaggactccatgtaatacccagcctgcatatacccctactctaagtatggggaccatgatgacattttgggtctttgtggtatcaaatgtcagctcatttaaaggctctatatccaatagcctttaaaagatctggacagccctgtgcatcattaccgtgctaaacgactataggtccctttgggataagggttgagggaacacctacttgcatacacttgatgtaacattatagggtccttcttcaagggagtatagcccccttcaagcaagtgctctaaaaactggctcatgtctggaaaacagtgagagatcatgatgtttttccattgcaatcaactttctgctcaccctctcttgatctattttgatcttgtaagttaagccacatcctcattgacccaccatttatcttgtgcctagaaacatcattgtttattagccgttgctctgaagccatgtgggttaggactcttgattttcttctggccttgctgttcatcatggtaattacacccacattttctctggcagttaagtgctgccccatggctgtgctattcctgaatcctatcatctcattgatattagggactccagttccatagcacatcttttacctttaaccctggcccacacaggacagccaccacggaacccctcactagcttattccttattattttaatgaaggaagtgtcttcttggcctttccagggaatatagtcagctggagtgttctctaaaattgcataataaatgcgttctaacacactcatttttctgaggcttcttttttttttctttttttttgacaagagtgcagtggcacaataatagctcgctgcaacctcgaactcctgggctcaagcgaccctcttgcctcaacctctagagcagctgggactataggtgcatgccacctcacccagctattttttttaagaggcggggtcttgctatgttgcccaggctggtcttgaacccctggcctcaagtgatcttcccgcctcagcctcccaaagtgctgggattacaggcatgagccactgtgtttggcttttctgaggcttttgacctcctcctcagtactctgctaagccatctcccctttctttcctacagactatcactgattccaagcttcaaggagccattccatattaggatcagctccaggcatcctcattgggatgttaaatccaaagccacaagtgtgtctccatatcattaaatcttccatgtccagccttatctttcaacctcattagtccagcaatcttggaatccattcccacatatgttttcccacagctcttttggtgaataatcccttatctttaatggcaacaatcatacttttcaactgaaagcacgctgagacctgaccgtacttatcaatctagaagtggccaggtgtggtggctcacgcctgtaatcacagtactttgggaggctgaggcgggtgatcacttgaggtcaggagtttgagaccagcctggccaacacaatgaaaccctgtctctactaaaagtacaaaaattaaccgggtgtggtggcatgcccttgtaatcccagctactcgggaggctgaggcaggagaatcacttgaacccgggaggtggaggttacggttagccaagatcatgccactgcactcagcttaggcaacagagtgagactctgcctaaaaaaaaaagaaagaaagaaagaaagaaaaaatagagaagcaaggagggtggcaatgggaggttgccctcctaacaagtggtggtggaggtgagaagggcacacctactggctcagaagggtctagattcttaaaggcatctacccaaatatcccatgtatcagtgtcctgacctcaccttatcagtgctgtgattttggcataggagatttgttagggctattaattcatcttcctctgtaactccaccacccttgcaatcaaatcttgtccttatttttagtacaatcgtctttcagctgcaggagatgcaggtcactaacattgccaccaggccgtgtggtcttcacattgtatccagacttaacaggacgctgacatgaatttggtatttttttcccctgctgagctttcattttatttcaagacagggtctctctctgttgcccaggctggagtgcaagtgttgcaatctctgctcactgcaacctccgcctcctgggctcaggtgattcttccacctcagcctcccgagtagctgggactacaggtgcatgccaccatgactgggtaatttttttattttttgtagacacgggctgtcactacgttgcccaggctggtctcgaactcctgagctcaagtgacccacctgtctcagtctcccaaagtgcggggattacaggcatgagccaccgcactgggccccctcttggtttttatggcagttaacaacagccaaccaattctgccttctctgtaattaccattgcgcccttatctttcaagtgccagagctattgaataagcattgcattccattccacctgtattccgccccaatctataggcaagttttattcattgcaactagcatgagagctaatattaccaccccagtcgctttttttttttttttttttttttttttttttgagacggagtctcgctctgtcgcccaggctggagcgcggtggtgcgatctcggctcactgcaaactccgcctccctggtttgagcaattcttctgcctcagcctccggagtagctgggactacaggggcctgccaccatgccaggctaatttttttgtattttttagtagagatagggtttcaccgtgttagccaggatggccttgatttcctgacctcatgatccacccaccttggcctcccaaagtgctgggattacaggcgtaagccactgcgcccgggccaccccagtcacttcttactgatatctggttggcaaatgatacaatttcagaaccccatattgagggtctgcttcataggatcacttttggcaccacccttcttaggatgagaaaaggatttgaatgcaaggagcttatttggaaggtgttcccagaccgcactggtatgaagctagagaagagagaaaagtagaagaaggaagtcaagagaggctctactaatgagcagattttcaccatggacacctcctcctcccattcatcactgactaagaatcactccccaggatttgcactccccagtacttctggttcaacccatggcatggaccatgtaaaagcccacaggtagagaatcacaggtttacaatgggatactattagtgtgtatggtaatgatgaatgctggtggggtatgtgtgtgtccttaactgtatatactatcgtaggctagaaaaaaaattgtccaccttaaccacctcacacaaaaggagatatcaagaaagcttatcttttttttttttgcttgggcaaatgtgtgtgtgtgtgtgtgtgtgtttgtatgtgtatgtgtgtgtcccctttgagaatctgcaaccatagatctttacttgacataggcttgctatttgaatttatactccttgatggtccagaaacccaaggtaagaaattaatgtaaaatttatccctggctaagtgatacccatggaatgctcagcaaatgtgcatgaaaaaataaaaaaaattatatgactttaaacacccaataaaaggagaaatgatttttgataaagccaaatgatgttacataatgcagccattaaaatgatgcttagaaccgggagcttgggggagagagataaagagaagttgtttaatacttgcagagattccgttctgcaagatggaaaagttctggagatctgttccacaggaatgtgaatatacttaacactactgaagtggatactcaataatggctaagatggtgaatttagtgttatgtgtttttttaccgcacaggaaaaaagagaaacaaagagttcttaatggtgaggagaaatgcttatggtagaatgctagagagaagggggacacaaaattgtatagaccatcttatccatcttatctcatctgtgaacaattacatataatagtaattatatattttatatataatatattatatatatacatatatatgtatatataactacagtggagggaaaaggtttaagaaaatattttaaaatactaataaaactgcctggcagaattatgggtgattaatttcattttatcttcctttctaaaaaaatctatttcagtaatgtatcacttaggatgctttcagttgcaagaaatggaaaatccaatttgaaatgacttaaaaaatgaaggggatttattggcttatgtaactgaaaaggccagaggtggggtaagcttcagggctgatttggttcagatgttctagtgatgtcatcaggaacccatttccttccctctttctgccctgccatctctggctccagctttaccccaaggctgactcccttcatggtaccagaatagctgtagcagtcccaggctgtgcacccacacaccatgctgtcccagggaaaggacccctctcttggcggctttcaaaagaagaggaaatttctttctcataagccacagataactgatgcttaagtctctttggccatattgcatcacatttccacctccgatcatattatcctgatcgatcttagcttaagcagataggctacaaggtgcagaagatacctgaaaaaatgtctgggcattgttaggaaggggagagaagagaatgaatgctggctggacagctaacaaatacatgtatttaagcctattccaaaattttagaataaatttgtatttctctgggaagttcaaaaaccacaagtgtaaaaatgctcttttatagaatattatatatagtatactatagcatgtattacataagtttatataatataaacatacaatatgtaagttataagtttgttatataaatatatatttattataatatatgatatatattatatattttgtacataatatatatcataagtttctataatacatactatagtatactatacataatatatttatatatgtactataatagactattatattacaaatataatataaataccataataataatgttctttatgcagaaaaagtaacaaaccacctttaccagccttttacatagactctatagaacgaggctagcattctgaaatcagctttaacctgacattacaattaagggtgacattaaaaatatttaatgagcagtatggcacagttatcaatcaatctgagtgggcacccaaacaatgggggagaggatgtcactggccattccactgcgttggtgacctcagccacaatcacagtcattattacttagcagtcaccattagctcagagtatgacataaaactgtccagtttaccttcagccaccagtgctggacacccactagccaagggattctcactcacacccagtccaacactgccaggacagagggatccccatcaccagacacacagtctcaagggagactaggattatcattgtcaaacaccagtggaagcatgggctaaagagaataaaaataaaatccagcaaaagcctccctagtcttctgttgcatttaatgaagagatacgacattgaagtcaagacaaaccaatgtcaaaatgagctcaatcatttacagctgtgtctactccacctggccaagcttcaatgttcaatctacaaaaatgagtaatacaagaattacctccaaaattggttatgaacacgtagaggtagtgtaaataaagtcattaatgcgggtgcagcacatactagggagttaatcaatggtaagtatcttttattaccatctcaagaggctggttgaaaaacctcagagaactgagaggcttataaatgcccttgtagggagattagctctctgatttctgaagtaaggaaacagccactggcctctccgtaatttaaccctcattttgggcttgaaccatccattcatccacactgcccctgtctctataaatataatgggctgacagcctctagtgctggaaacagctcttcctgagctgggatttctgacagctcaacttccacaagctgttcatgagttatttcaagggacattttactgtcaatcacttacccccgaagtggactgcacagtcctgccatgtgaccaggattctgaaaggggcgagaacaacatttgcttcctggaaatcagcatactggttcacgacccataaaaggaagctgagaaaaggaatgtgatgctaaacaaggaaaggaagctattcttaccaacaactccatatatgtcaaccactgtgctatcttgctgaatccccacaagaaccccgggaggcaggtgttagatgcccaccttacaggtgaacaaactaaggcttaaagatgctaactaacttgcccaggctggtatggggaggagctgagtttcacatctagggctctttgaccgcaaatttctttcagaatttctcagaggtgatgctgctgacattttgggcagggaagtttttttttattatatgatgtttagcaactctggttcctgagcattaaaggtcaacagcatgcccaggtcattgtaacagctaaactgcctccacacagtttcaaaccttctatatctataataaatagatcttttagatctataataaatctatttgtaatagataaaaaaacatcttatttcagaacaggattctggcacagagtaagaagagaaaaggaggctgggcacggtggctcatgcttgtagtcccagcactttgggaggccaaggtgggtggatcccttgagcccaggagtttgagaccagcctgggcaatgtgacaaaaccctgcctctacaaaaatacaaaagttagccagccatagtggcacacacctgtggccccagctactcaggaggctgaggtgggaggattgcttgaactgggagggtcgagctgcagtgagctgtgattgcactactgcacttcagcctgggtgacagagtgagaccatgtctcagaaaaataaaaataatttaaaaataaaaataaattaaaaaaatttaaaaataagtaaaaaagaagagaaaagaagcttcacagatgtggccatgggtgatattggaaatgcatttgtgaatccaagtgtgtgtgttcctgtctagagttaataatgcatctctgtgcatagagtgtgcatgccacactatcactgcacacgtgcatgagatgtgctcttgtgtatgcacaggcatgcaaggccctaagtcatctgggaccctttcttctcaatcagctcccacattcaatcagtctcttcagtcctgttgattccccctcgtaaatatatctcacacccatttctgctctccatcactgctacattggtctatatcaaacttcttcatctctcatctggaccactgcactgaccctatatctgatcacaggtactaccaattcattctccacaccactgaccaccagcattatctgtctgtaaggcaaatcagaccacatctccctctagctcaaaattcctcagtcgttgccattgcctatagcaattttagaagcagaaccttgtatctaaatgaagtcttcaaacacaagtgcaatacgtaaagcagataaatgcagaaatgctcttttggattatgcagactcctcagcaaggcatacaaggtcttttatgatctgtcctccagccaactactacagcaacttctctggcttggtggtcatgtttgagggctctagaattccctacctgcattcaaattctttgccacttactaactgtgcaacttgggcacattgctttacttctctgtgcctgagtttcttgtagataaagtgggactaactgcacttaatggagttcttttgaagattagattcattcatatttgtgaaacacttagaacagttcctgtggttcccaaaggaatctgtggtgggattgaggcccactagagttgcctacaatgtgaccagttaaatacacatccttggattagctttcctctttctctctttcatttcaattttttttttttttttttcagatcgagtctggctctgtcgcccaggctggagtgcagtggtgcgatctcagctcactgcaatccctgcctcctgggttcaagcaattctcctgccttagcctcccaagtagctgggactacaggcttatgccacaatacccagctaatttttgtatatttagtaagacagggtttcactacgttgaccaggctggtctcgaactcctgacctcaagtgatccacccgcctcagcctcccaaagttgagggattacaggcataagccactgcgcccggccctctctttcactctttagtccccccacctctatttcctcagaccacttccccaaataaactatttgcacacaagatcctgtcttgacctctgcttttgtagggaatctaagccaagacaaaaaaaggttcccaaatttttcactattacaaaaaaatcctgctttatgtttttatgtttccttgtgaccatgtgtgagttattctctgaggtataaatctaaaagtagaactgctgagttacatgatgtgtgcattttcgattttattagaaattgccaagttactttcccatatggtggaactaatttacattgttgtccacactgctgaaaattcccattttcccacattctcttcaatattaatgttgtctggttttaatttttgccagtaacatacagcctcattattgtttttaatatgtatctccttgaccgctaacgaagttgagcatctcttcttaagttcattgctcattttgttttccttttatgtattttgcttattcacatcttttgcccattttctattgggtttctttgtctttttgttattgatttatggaacttcttcatacattctagatacaaatcctttatctgttaactaggttgtgaatattttctctgaatgtttcacttgtcttcaaattttgcctatgatacttagtttttacttttaatgtaatcaaatatatttttccctttattgtttgttattttttatgtcttgttttaaaaaatcttctttttatgttactttatgataatatttacttctttcctttcataattttacattttggtttagggctttaatacatctggaatttatttttatacatggtataaagaataactctttttgagctaacaggcattgagaagttttactttgcattaaaaaatgtttcttgcagagacatcttggcattttgcataatgtatatctgacagacctagaaatggcagaaaggtagaaaagaaggcgaaagcactgagaaactagggatggtaaagaaatttcaatttcacattttatccaatgtgagtactgtgaccttgtttgggcaatcacataaaaaccactttgaaaaggtttacattggttcttaattatctagaggtgtcatattattgaacattttttgattccctcacttccattagtcagctggaatatgctcagagaaattgcaaaagctatgaagtgggaaaataagtagcttcagtctgaaccaaacacaatgagaaaaggaggcctgcaggaagaaaattacatttcaaagcctaagctaaaaagtttggggattttctgctattttggaatagttactcactttatattcgttcactcagcaagcatgtattgagcatctactccattccaaggactatcctgggtgtagggagctgtagagataaataagtccctccccttgctctcaacaatttctcttttaggcaaaaagacaactatgtaagaaaataaattttcattataggtgataaatatatgaaatgcctaccatacaccatttaaacataataccgagcaggaggaattagttatctacactggggaggaggaggtggtcaaggagatgttcctggagctaacatgtgaggaactattcagcggtgaacaatggttgaccaggtagacaaggaggtaggtatgagatgacttcaaaggacattccaatcagagggagtagagaaagcagacatgtgagaggcaactgtgcctgtaggtggtgggaagggtctaaaaatgtcacacaaacaggatctattttcccaattttctatttctcctcttcagtttgagcttgtcttagttctgaagaaaaggcccatttcatcaaagtaaacaaatatgggctgaaattgaccttcttttgcatatatatctagatttcttttatttatctaacaatttttgttcagcacctactacaggtgctagcaatacttaaggaattcttgtgaaaagacatacagaaatacagacattagtaagacagatctgctaatggaaggttgtacccaggtcctggatgtgaaaacagggcacctaattctgcctgggagagtcaggaaagagagacagaggaagtggtccttgagttgaaatttgacaggtaaataaagtttgccaggcagagaagtaggaaggagacaattctaggtggaggctgcaggatgttacggtaccaacgtggtcactacacccctttcacctgcaactgtctcacccacaatgccctgctcaaggaagagaagcaaagccatcctttgaaggatggtggctgctgattggacctcctcacaggcagacagtgtcctatgacgtatccagatgcaagggctttacccaattaggaagcattggtaactggtcaatcaggctgcatcccctaagaatttagagaatacaaattggactgtctggtaacagcagaaggatgatgatgccagctctcagagaaaagaagaaacctggctagagcaccaattgtctgtgattatttcccccaaggatagaagattaattcatttatccataggctcccagcttccagtcatcaaggattgccctatgggatgttaactccttcacgtttccaggttgcatgtaggtcagaatggctgagtaggaccccactggagttgccagattgttatgttttctttcatgggctctgtctctttggcctttttttcccctccctccctccctccgtcctttcctcctttcctcctttcctctttcctttcttccttccttccttccttccttccttccttccttccttccttccttcctttctttcttctctctttctttcttttctttctctctctctccctgtctctctctctctctctttcttttttagatggagtttcgctcttgtcacccagtctggagtgcaatggcgcaatctcggctcactgcaacctccgcctcccaggttcacaagcgattctcctgcctcagcctcctgagtagctgggattacaggtgcccactaccatgcccagataattttcatatttttagtagagacagggtttcgccagttagccaggctggtctcgaactcctgacctcaggtgatcggcctgcctcggcctgccaaggtgctgggattacaggcgttaaccactgcacctggccgaccttttgttctactttctaggagagctcctcaactttatttttcaactcctgtgctttcttttatatttgtccagcatattttaaaatttttagagcactcttttttctctaattatttgtcttttctgtagcgacctgttcttgttttatagatataatagcttctcatgtctctctggggattttaattatcttcttcttctctctgtgtcatctctgttctctctggttatttatcctttcttctactctcttttatatgttggagatttttctcagaagtctgataatattaattgctggtttttatttaagagtgaggtaactaaaaagctgattggaactataatattctgattgggctttagaattggggaaatttgctttaggtaagttaggaaataagaagtttccttctattctgagtggcccccaaatgccagataaatggaagttattccatttctctatggaagaaccctctgcctggggggagatgtcctgtgggtaggtgttttacactcaagttttgagaatgtgttccacttatagactttctttctttctttttttttttttgagaccgagtctcgctctgtcacccaggctggagtgcagaggcgcgatctcggctcactgcagcctcggcctcccgggttcaagcgattctcctgcctcagcctcctgagtagctgggattataggtgcctgccaccatgcccagctaatttttgtatttttagtagagacggggtttcaccatgttggccaggctggtcttgaactcctgacctagtgatctgcccgccttggcctcccaaagtgatgggattacaggcgtgagccactgtgcctggctccacttatagactttcaattagtccatccatttgcagcctcacgtctcagtcacgtgtaccctctggggacacatgccatctctgccagacatgatggctttcttctattttacattctccttctagtatgctccaggctgcaacttcccctgccctactaacagttacccttccttctgtagttttttcctccttagaaacttgttgaaatctctccttcaccttgctttttgatcatagtctttttttctagtcatctacatttattaatatgacggtacatttggtcttcttagttattccttggttttaaatacttttttgatgttctgttatattaatgtttcactttataatctgtgattacttttctgggacgtgcatgctgtttttgtctgataataaggattttttttatagtctgatatttttctagttgatcactttttagctatgattttgaataacataactgattctagcatacagctagatttaaaagtccaatctgatgatttatgtttttaatttgtgagtagagtttatttacatttttgtaaatatatatatatttgaagttttaggaccaccttatgcatgatttctgcttattattctttctttattccttctctttgttgatagacttttctttataccaacactcttttttagtttactcatttggaagctatagattgttctatatttttagtggtttctttcattttttgacatatgcacacttaactcctcattttctaacaaaactactgttattaaatatttcaatcctaactttggacattgtcacaatttaactacttgttgaatacctctctccctccatctttttactctttagagttttaaaaatagtcaatagtttttttgatagtcaataattttctctacatttaaaatcaatttctgtgctatcattaaatacatcctctaatagttattttagtgagtgtctagaagtatcaactctcagttattacactgaaaattcattgtttaaatttttaaatgggcaactttttaattgaagtgtaatatacataaagaaacctacaaaaattatatacaattgattctcattatttgtgaaaatcatgttccataaaatcaccatgaacactgaattaataaatactgaaccattgctcccaggggaaatacagagttaggctcccgtgagcctctggtcacaacattttcgtcagccgatcaatgtgtaatcttgttttatgtgtgtttctattgaaagacaccttatttaatatgtatggttgattcattaacattgaacttactgccaacagcactgcaactcatgcctgaatgaagcttactaacacatgtattttctctataaggcataccacaggcttatgataacactaggtaacacttcagctgtatgcttccaggccattttaaacagcaaaatcaccatcagaaagcacaaaaatgcagaaaaacgtgcactaagtagcctgtgaaaaggacacttgaggccaggcgcggtggctcacgcctgtaatcccagcactttgggaggccgaggcaggcggatcacaaggtcaggagatcgagatcatcctggctaacacggggaaaccccgtctctactaaaagtccaaaaaaaaaaaaaaaaaaaaaaaaaaaaaagcccgggcgtggtggcgggcgcctgtggtcccagctactcgggaggctgaggcaagagaacggcgtgaacccgggaggcggagcttgcagtgagccgagatcgcgccactgcactccagcctgggtgacggagactctgtctcaaaaaaaaaaaaaaaaagaaaagaaaagaaaagaaaagaaaaaaaagaagaggacacttgcttctaacatgagagctgaaacaagtaagcagagagttgctttgtccgacttcagcttggaacatatgcatccagtgactcaaatttttcccctcaatgcgtatatctgcaaacgaccacaaagctcagcaagtattgattttggggttgcaaataaatttgagtgagtaggtaaattaacaaatacagaatcagtgaataaatgaggatggattgtatggacacacaatgacttttcataaagtgaaagcacccatgtaacaagcatctgagtcaagaaataaagcgtttccagcattctctttggcctttttccaagggtaaccatttttctggcttctgacaccatagattggtttgcctgctttttcacattacctcatgtaagcatgtgttatgtacttttttgtgtctagcttcttttgttcaatattatgttattcatccacgtcacaggttgtaataaatagtattgatcattctaaagcatttttgtcagtctgttctatacaattagttttgtcagaagtgagtttgtattcctagtgttgattttgttgattgtctttcctagaattgtattccctgatgtgttttagacttttgattttcagggtcattttaagcaagaagcttcttgcttttcttcatgtttctcttgctttctagtaattgagtggtgtgctactgccttccctttgtcccccaggctccagtccaaaactaggtcttacagggatgttgatgtgctgcaacattggagatacccagttccagagtctgcacgagccttggctcaggtcctgctcatgaggctgtgtctgtccacctgcctcctttgggccccatgttgctgggaacagttacaccgggcagcagagtggcagtctttttgagcccctttcaatggagtagcatcccactccagctcctggcttcatgcagggagcctgactctattctgtgccttgtgtggagatgtttggtcctgattccctgctaccgctgtctgggtccagacctggagcccagcatgccctggctttatccttgctcactgctggagatttatggtcccagagatgcttgtcttctctttgatcccagctatccattttcagtcatctcttcttatatttgacctgtcattactgtgtctggacatgggtgaagttgtcgaggagtgaatttaactgtactatgctgcctgggagtctgtattgtttgttttatcagagaattaacaagccatttttatcttgaaatacataaagtattcaagagtttcctctcaggtggaaacaattcaaatatctgtcaactgatgagtggataaacaacatgggtatatctatacaatggaatattagtcatccattaaaaagaatgaagtattcatacatgctataacatggacgaatcttgaaaacattacgccaagtaaaagaagccaaacataaaaggccatatattgtataatttcatttatatgaaatatacagaatagacaaattcatagagacaaagagtggattggtgctttccaggggcttgggggaggggagcgtggagctgataactaatgggtatggggtttccttttggggtgatgagaatgttctggaactaaagagtggtgatggttgcacaacacatgccttctaactgctctcatttgaaggtatcactccttcgcaccaacacaaggccaggtcctgtctttattgaacatctttcacaatatattgtgaattacttgtctttgggtctgtccctctaccagactataaacattttcaagagaagcgttttttcctattcagatttgtatctctgttactttgcttagtgcctggcacagagtaaatccaagtaacactgctgaataaatgaatgaacaaattagttgaactgacatgaccacttcaaaaaaagtcattctttttctgggtccctcagtttattgtcagaatcatttcccagggaaagattttcattcagagacactgtgatgccctcagagttaaagcatttgatgtgaggaagcagtgcaagcagcccttaccattcccagggtccccctaaaactttgacctcccagcctcagccagtcctaacctaacatctgctggaggtgcagttgcaatggctgaattattcaaaatattcccaacaactaagcacaaaaatgctgttgctgagtcactcccagcacaaagcattttctttatgatgtctgccctctgaggtgtaaattgcaagtctcacagcctcactctatagaggtgagctaaatgacttctccagggtcagggaacaaatgatggaataagcgatgcatcaaattggaagcgatttctagggatctatgcttctgtatttgactatgtatatgtaggtgtcagggttggaaagtccccaaatatatcacctattagattaagatcttgagatacaaaaatttattcttgaatgttagtgccaattcttcatgacgtggttgaaggtgatttcttcttgttccaacagtgtggaggtaaggaagggaaagggttattaaccatttccccccatgttaaccctttatacactcacagtgatttttaaattatccctttcttccatattaaaatttgcagtccattcattaaaaaaaaattaagaacctattatgtgccagcaattctggatttcaacataaagtatggtccctttctttaaggtctgagttcatagtcttcctttagggtttgctttaaattcttatttctgacgctaatccagctttgtaaaatatgctcccaaatctaccacctggcaaacgttttgtagtaatttattattctctgtgcttttaacacacgggaaaatcagtgttaatctctctccatgttatgccaatgaccagcagcctgtagacaagttaggattgtctgcgcctggtcacattgaaatactttcaatgacctgcgatggaggagttgatttttgcttgtggaagatacagagtagcaacttgaaaataattgctttttagcagtgagtgtaaagtaccatgggaacatccccttctcacacagtatacacaggtctgtcataatgtagacagttcatctggcttgactgatgcaaacagggcttttctgggaaatctcacagccatcaacattgttctgcagttctcaatcactttgtgtgtccccagagctgttgctgagggacacagcaggcagagcagaggtgcagcttttcctgtcgtcttgtcatctaggggacccaaggagactgaagccatcatttcctttgctgactcaatatcctgggcaaaacggatgtatggggtccctggtctgctctgaaagacacatgctagggttccaaaaccagtccttcagcctgcctccaacagtgatgctgacttactcacacagcatctctctgtgctatttatgccacctgcaaaatagagttacacagtaaaagaatttggaatgaaaacactgttcagtgaaataaatgactttttctctttttttaaaacttcaggggctaggtttttctaactggtaatagtcttctaagagggggatgtagggatccagtggctcatgcgagtaaccccagaggctgaggcaggagaattgcttgaagccaggagtttgagaccaacttgggcaacaaagcgggaccccatctctacagaaaaaaaaaaagaaggggatgttttaactcatagtaacctgtcatttattagttctgccttcaaatgctgtcattctgctgcttctagtcagcgaggcattggagggtctactttcatttgagaatgacttctccctcctctgaatgctggttgtagcatcttcctatatgcaactatattaaagctaaatacatgagggtagggacggtctgtcttgtttgttactgtcttggtttgagtttccacagaagcagaccctgggataagcagaccctcgagtgcaagcaatttatttgagaggcgatcccaggaaacactgatagcagagggagacagggtagggaagttagcccaaaatgaatcattactaaacaagttagcatcgtgggtaagtggaacttaattccactggaaaacttagggaacagggtattacacacatctcagagctgtcccaactgaggagtaagggaacttgggtatttatatgacagtttccattagtcattggtttagggctgcccccatttaacataacagtacatccacatggaaaagaatgatccttaatccctacttcacttcacacaaacaatataatgcaagaaggatcatatacctagttgtaaaagttagaaccataaagtttctggaagaaaatgtgggaggatatgtgtgcaaccttagggtaagcaaagttttcttgtgcaggacagagaaaacactattaaaaacacccgaaaaattaattaaaaagtacttaatcaaaattaaatacatctgctctttacaaaaacattgttaagaaaatgaaaaggcaagtaatggaatgggaaaatattttcattacatatatctgacaaaggactggtgcccagaatatataaagaactcctacaaatcaacaacgttcaacgatttgaacagacacttcacacataatgtatacaaatggccaataagccaatatcattcatcatcagggaaatgtaaattaaaatcccaatgagaaaccactagacatcaaccagaatggctcaaactaaatacttggtaaggcgaatgtcagcaaggatgtggtcatgtcagcaactggaactcttatattttgctgatgggagtgcaaagtagcacaatcactatggagaactctttggcagttttttacaaagttaaacatacatctctctaagacccagaaattatatttctaggtatttatttatttattactgtttttttgagatggagtctcgctctgtcacccaggctggagtgcagtggtgcgatcttggctcaccgcaacctccgcctcccaggttcaagtgattctcctgcctcagcctccggagtaactgggattacaggtgcccaccaccacgcccagctaatttttgtatttttagtagagagagggtttcaccatgttggccaggctggtcttgaactcctgacctcaggtgatccacccgccttggccttccaaagcgctggaattacagacgtgagctactgcacctggccctctaggtatttattattgaagataaatgacaacacacatctacaaaaaataaaaataaaaagcttgtacaaaaatgttcataacagcaaaaacaaacaaacaaaaaactagaaagtatcccaaatgtccaccaacaggtgaaaaaaagcaagctgtgaagtagtcatataatagaatgctatttagcactaaaaaggaatgaattattggtacatgcaacaacatggatggagctaaaaaaacaaaattacactgaatgaaataagcatatataaaagaatatattctgttttatttcatgtatataaagtccacgaacaggaaagctaaggtgataaatcgaccagtggttgtccttgcagggtggtctgatttgagtaatggaaaggaggcactcacaagggaacctggtggttttgaaagtgttctatattttgttttggatggtggttacatgagtatatataggtgccaaaactcgcctaattggatatgtgagatctgtgctttttattatctaaaattataccttaataaagattacagacttatcttttaaaaagaaaacacattagccattaacaatagtgggtgatttgctcagtgttctgccctctactagactgtgagcttcaagagagcagaagccccatttgttttgctctctactatatgctcagcacctatcatagcacctgggaccacttgagtgctcaagtcatatttgttaatattataagtttgtaagaacctctgtgcattgagctgtggctttatcctatctccctttgcagacatgatctgttcttggcagatgctggtggccccagaagctcgagcacaggtgcactgtctaggaagggagcttgcaggtgggaacccagcagggccctgggtgtccttgggcactgacagggtcccaactgtgagcaccatctgctcctgtgaagggtgtctgacagtagccgcagccctggacctggaaggtgagtacctctgagacccaaagtcaggctcccattcccatcctccctgcctgtagggagtccacggaaagtcactttaaccctggaaatagaaagcaccaacatatgtaccactttgtaatttaccaagtgttttcccacatatgttcttattttatcttctccatgaccctgtaaagtagttgtctaataaccttattttacagagaggttaactgacttcaacaagctcacgcagctggcaactgacaaacctgggattcaaaccaagtttttaaccatttattcctatattaaatgcagtactgctgtgtcatttatggatcttcagaagcaatttctgaaacctgaccccttcagtaagctttactggactgctggaaagataagtagcaggccccgcttgccttttatccaatttatcccatatgcttccgagatattaacctgcctggaccactactaggatagtgtcattctcccatgcaaatttttcatattcctcatcacctaccaagtaaaattcacattccttagctgctgttcaatgctcttttgccccaactcacctctgtagcctcattttccttaaaaaacaacttcgcattctagctggtcatgtcattatcctcatttccacaactttactcctcaacttctccttcgtatggaacaacagttccttccatcttccctcgggaaatttttctcacccttcaagtcctcactcaaataccactgccactccctattgggaagatttttacttcatttgaaccctgagagtacatggtttgtacctttcctgtggcattaactgtcaggtgtcatgggtatatttgcatcttgcttgttttccttattagatcctgtgatcccagaaggttagatacatgccttatccgtttctgtagcccctatggtgactagcatagctgtttgcccattgtagatatttaattgatactttgtagagtgaatacattaccacctctccaaccattgtctatgaattgaatatcctttggtatgcatagctttaaacattgtttgcgttttaattctattttatgtatttggttagcatagtctctaccctctgtatactttgcttctaacttgacatagattgtatgaatatctaaattctttgcaaatgaggtggacacgtggagattgtggagtccacagctctactctggctctgccgttcactggctgtgtaaccttggacaaaccacatctactctctggattattttatttattttattttattttatgagacagagtcttactctgtagccccagctggagtgcagtgcgacaatctcggctcactgcaacctccgcctccggggctcaagcaattcttgtgcctcagcctcccaagtagctggggttacaggagcctgccaccatgcctggctaattttttgtattttagtagcgatggggttcaccatattgcccagggtggtctcgaactcctgagctcaggcgacccgcccacctcggcgtcccaaagtgctgggattacaggcatgagccactgcgcctggtcactggaccttattttgcctccatctattagatgggggtaataatccctgctttacttctttaattcactgcaagtttgttgggaggataaaggaaataacagatgtgtaagtgctttgccgcctataaatcacccagaaatgtcgtttcattgcatctgctgttaaatgcaggcacatcttttgctgctggcagcccccacccatctgctcctctttcggtgaaaaattgactgtcgggtggcagggaatgtcgagcgggcggcaggatggatgatgaagaagcaaccatgtctcctgaatggcgtgtggcactggggctttgttgtggtgggtgttaggtgaagcggggacattgtcttctgaaaggccgctatgaggaagggaaaagcctgtgtccaggcagcctcgactaccagcctagtcccagggtgtacgctacagggagtcaggcagtttgggaaacttctcagactcagagcttcagaagttgacatgggctgcctgagggaaggtgtgggcccgaatgctgtgcaagtgcgacatcaacttccactaataagggtcacaaccgcccttcaacgtagaagcaaccatctcggtgcccaaggtcaagagagacaccgaagcccggaaatgccctaagcgggaatcttcggagcctgcccattggcttctgctgaacgggagggtgggccctggggcgctccgcttactgattggttcgatgccagattggcaggtccccgccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtgaggcccgaaggcaggaatatccctgaggtgcccacagccctcaggaggggaggctccgcgaatacactgggccagtgccccgaaagcaatgccgaggggacaccgagtgactgccaggcctgttggggaatggacaggccgacaactaagataggaaatacatacatagcagtaggagacatggttggaaccctttacagtctcaaaataattatgcaagggagtagtaaacattcatatattcaatgtgtatttattgagcgtcaagtatgtgctagactctattcagggtgctagggatggagcagtgagcaagatataaacgctccccacccttattgatgtttttagtttagtggaggatatactatttatccaaataactaattacagaagggacaactgagtcatcccgtaaccaagcattcacacaggactaaatttgaatcctcgcgttgccagtgaatttctgggaccttgctttagttacttaacctctctgtaccttatttactttgtcttaaaatagagataataatataatagtacaggccctcagaaatattgggattcggttccagaccatcacaataaagcaagttacgacctttttggcttctcagtgcatataaaacctgtgtttgcactgtactgtagtctattaacttgtctaaaacaattatgtctaaaagaacaacgtacccaccttgattcgagaatactttattgctaaaaaatgctaacactcacctgagccttcagcaggtcagtctttttgctgctggagggtcttgcttcatgctggtggctgctgactgatcagagtggtggtttcccaagattggggttgctgtggcaatttcttaaaataagacaacaatgcagtttgtcacatggattgcctctaactttcaggaaagattgctctgtagcatgcaatgctgtttaatggcatttttacccacagtagaactcctttcaaaattggagttaatcctctcacattttgctgctgctttatcaactaagtttatgtgatattctaaatactttgctgtcatttcagcaatgttcacggcatcttcaccaggagtagatgccatcttaggaaaccactttctttgctcatccataaaaagcaactcgtcatctcttcaagttttatcgtaaaattatagcaattcagtcccatcttcaggcttcacttccaattctagttctcttgctctttcaacacatctgcagtcccttcctccattgaaatcttgaactcctcaaaagtcatccgtgagggttggaatcaacttcttccaaattcctgttaatgttgatatgttgacctccgtccatgaatcacaaatgttcttaatggtatctagaatggtgaatccttttcagatgttttctattaactgcccagatccatcagaggaatcactatctacagaagctatagccttataaaatatatttcttaaataataagacttgaaagcagacaattactccttgatcatgggctgcagaatgaatgttgtgttagcaggcatgcaaacaacattcatctctttgtacatctctaaccaagctcttgggtgaccaggtgccttgtcaatgaacaataatattttgacaagaatctttttttctgaggagttggtctcaacagtgggcttaaaatattcagtaaaccatgctataaacaaatgtgctatcatccaggctttgttgttctatttatagagcacaggcagagtagatttagtacagttcctaagggccctaggactttcagaatggtaaatgagcattggcttcaatttagagtcaccagtgggattagcccctaatgcaagagtcagcctgccctttgaagctttgaagccaggcattgacttctcctctttagctatgaacgtcctagatggcctcttcttctaagaaaaggctgttttgaatacgttaaaaaatcagatcagactttggcttaagggaatgttgtgactggtttgatcttctatgcagaccattacaactttttccatttcagcaataaggctattccacttatcattcctgtgttcactggaatagcatttttaatttcctttaagaacttttcctttgcatttacaacctggctaactggcataagaggtctagcttttgacctattttggctttcaacatgccttcctcactaagcttaatcatttctagcttttcatttaaaatgagagatatgtgatttttcctttcaccttaacactttgaggccattgtagggttattagttggctggatttcaatattgttgtgtctcagaatagtgaggactgaggagagggagagagacagagcaaaggctggtggatggagcagttggaatatacataccatttattaagttcactgtcttctatgggcatggtttgtggcactccagaacaattacaatagtaacatcagagatcactgatcacagatcaccatcatatataataataataataatgaaaaagcttgaaatattgtgaaaattaccaaaatgtgatacagagacatgaagtgaacacatgctattagaaaaatggcactgagagacttgattgatgtggggttgccacaaaccttcaatgtgtaaaaaatgtaatatctgtgaagtgcaataaagcaaagtgcagtaaagggaagtgtgcctgtacctacttcataggattattttgaccattgcataagctaatacatgtcaatcacctaaaatagtgcctagtatatattaagttaggggtttgctcttattatcattttgttctagtggtatgctttaacaccatgggttgccagtcattcagttcccttttgtctggtttgactattggatgaggaacctgggattttggattatacacatacatgtacgtcacatgtgtgcacacatgcatacatgtttgtgtattttgggcagcagtagataggagaagaattaaagagaataaaggtcccaggtagctgggtgtggtggctcatgcctgtaatcccagcactttgggaggctgaggcaggcggatcacctgaggtcaggagtttgagaccagcctggccaacatggcaaaaccccgtctctacaaaaaatgcaaaaattagccgggtgtagtggtgcctgcctgcagtcccagctactcaggaggctgaggtgggagaatcacttgaacctgggaggctgaggttgcagtgagctgagatcgtggcactgcactccaacctgagtgacagagcaagactctgtctcaaaaaaaaaaaaaattcccacaacatgtacagaggccacaacatacctgaaaaaacctcagcatgtaatgtatagtgagaaggctagcaaatctggtgcttagagaataagggaaatggtagcttgagataagcctgtctgaagatgtaggcaggtgccttgtgaacattattataaatccagtgggaagccaccgaacagttttaagcagaggcattttcatctttgaaagatcactctggctgtggtgtgaagatggaattggaggggaatatgagtggattcagaaagatcatttagaatgctattgcagtgttataggcaagagatgatgatggcttagactcagggcatggcagtagagatagggatattgggaatatattttggagaccaaaatgaaaaggcttggtgattgattgtatatgggtggtgagagtaaaggacttctgggtttctagcagaagcaactgagtagatggttgaagaatgggaaacactggaggaggaacagtgagggaaaaatccaagatgtcagttttggatgtattgaatttcataagattgtgaagcatccaagtggagatactgaataggtggttgggtatattggtctagactcagaaggaagatctgggctagagatgtaaaggtgtgagtcatcagcataaaggtgatatttatagtcatgggattaggtgagattcgggaccaagcttaaacgtaatccaacatttgtaagttgggtagaggggacagagccccaaagaagactgataagaggcctggcacagtggcttatccctgtaatcccagcactttgggaggccaagatgggtggatcacttgaggtcagaagttcagaccagactggccaacatggtgaaacccgaggctacttgggaggctgaggcaggagaatcccttgagcctaggagacagaggttgcagtgagccaagattgtgccactgcactccagcctgggcaacagagtgagactctgtctcaaaataaataaataaataaataaataaataaataaataaataggaaaatacaacaagatagccgaataggaacagctccgatctgcagctcccagcaagatcaacacagaaggcgggtgatttctgcatttccaactgaggtacctggttcatctcattgggactggttggacagtgggtgcaggccatggggggtgagccgaagcagggtggggcatcacctcacctgggaagtacaagggttggggaatctccctcccccagccaagggaagccgtgagagactgtactgggaggaatggtgcacagatactgtgcttttcccatggtctttgcaatcagcaggccaggagattccctctggtgcctacaccaccgagggccctgggtttcaagcacaaaactgggtggccatttgggcagacactgagctagctgcaggagtttgtttgttttttttttttcacacgccagtggctactggaaagccagtgagacagaactgttcactcccctgaaaagggggctgaagccagggagccaagtggtctggctcagcgggtcccaccccaacagagcccagcaacctaagatccactggcttgcaattctcactgctagcacagcagtctgaggttgacctgggatgctgtatcttggtggggggaagggcatccgccattgctgaggcttgagtaggtggttttacccttacagtgtaaacaaagccaccaggaagtttgaactgggtggagcccaagacagctcagcaaggctgctgcagccacactgcctctctagattcctcctctctgggcagggcatctctgaaaaaaaggcagcagcccagtcagggacttatagataaaacccgcatctccctgggacagagcacctggaggaaggggtggctgtgggcacagcttcagcagacttaaatgtccctgcctgacagctctgaagagagcagtggatctcccagcatagtgttcgaactctgataaggaacagactgcctcctaaagtgggtccctgacctttgtgtctcctgactgggagacacctcccagtaggggccgacagacacctcatataggagagctctggctggcatctggggggtgcccctctgggacaaagcttccagagtaaggaacaggcagcagcctgttctgcagcctccgctggtgatacccaggcaaacagggtctggagtggacctccagcaaattccagcagacctgcagaagaggggcctgactgttagaaggaaaacaaacaaacagaaaggaatagtatcaacatcaacaaaaaggatgtctactcagagaccccacccaaaggtcaccaacatcaaagaccgaagatagataaatccacgaagatgaggagaaaccagtgcaaaaaggctgaaaattccaaaaaccagaaaacctcttcacctccaaaagatcacaacgcctcgccagcaagggaacaaaactggatggacaatgagtttgatgaactgacagaagcaggcttcagaaggtgggtaataacaaactcctctgagctaaaggagcatgttctaacccaatgcaaggaagctaagaactttgaaaaaaggttagatgaattgctaactagaataacctgtttagaaaagaacagaaatgacctgatggagctgaaaaacacagcacgagaacttcatgaagcatacacaagtatcagtagctgaattgatcaagcagaagaaaggatgtcagagactgaagatcaactcaaagaaataaagcaagaagacaaggttagagaaaagagtgaaaagaaacgaacaaagcctccaagaaatatgggactatgtgaaaagaccaaatctatgtatgattggtgtacctgaaagtgatggggagaatggaaccaagttggaaaacactcttcaggatattatccaggagaacttccccaatctagcaaggccggccaacattcaaattcaggaaatacagagaacaccagaaagatactcctcgagaagggcaaccctaagacatataatcgtcagatacacaccaaggttgaaatgaaggaaaaaatgttaagggcagccagagagaaaggttgggtaacccacaaagtgaagcccatcagactaatagcagatctttcggcagaacccctacaatccagaagaaagtgagggccagtattcaatattcttaaagagaagaattttcaatccagaatttcatatccagccaaactaagcttcataagcaaaggagaaataaaatcctttacagacaagcaaatgctgagagatcttgtcaccaccaggcctgccttacaagagctcctgaaggaagcactaaacatgaaccagtaccagccactgcaaaaacataccaaattgtaaagaccatcgatgctatgaagaaactgcatcaactaactggcaaaataaccagctaacatcataacgacaggatcaaattcatgcaacaatatgaaccttaaatgtaaatgggctaaatgccccaattaaaagacacagactggcaaattggataaagagtcaagacccatcagtgtgctgtattcaggagacccatctcacgtgcaaagatacacataggctcaaaataaagggatggaggaatatttaccaagcaaatggaaagaaaaaaaaaagcaggagttgcaatcctagtttctgataaaacagactttaaaccagcaaagataaaaagagacaagagcgttacataatggtaaagggatcaatgcaacaagaagagctaactatcctaaatatatatgcacccaatacaggagcacccagattcataaagcaagttcttagcgacctacaaagagacttagacttccacacaataatagtgggagactttaacaccccactgtcaatattagacagatcaatgagacggaaaattaacaaggatatccaggacttgaactcagctctggaccaagtgaacctaatagacatctacagaactctccaccccaaatcgagagaatatacattcttctcagcaccacatcacacttattctaaaattgaccacataattggaagtaaaacacttcttagcgaatgcaaaagaacggaaatcataacaaacaatctctcagtccacagtgcaataaaattagaactcaggattaagacactcactcaaaaccgcacaactacatggaaactgaacaacctgctcttgaatgactactgggtaaataaagaaatgaaggcagaaataaagatgttctttgaaagcaatgaaaacaaagacaaaacataccagaatctctgggacacctttaaagcagtgtgtagagggaaatttatagtactaaatgcccacaagagaaagcaggaaagacctaaggttggcaccctaacatcacaattaaaagaactagagaagcaagagcaaacaaattcaaaagctagcagaagacaagaagtaactaagatcagagcagaactgaaggagacagacacttgaaaaacccttcaaaagtcagtgaatctgggagctggttttttgaaaagatcaacaaaataggctgctagccagactaataaaaaagcaaaaggagtagaattaaatagatgcaataaaaaatgataaaggggctgtcatcactgatccctcagaaatgcaaactgccatcagagaatactataaacacctctacacaaataaactagaaaatctagaagaaatggataaattcctcaagacatacaccctcccaagactaaaccaggaagaagttgaatccctgaatagaccaataataagttctgaaattgaggcagtaatgaatagcctaccaactaaaaaaagtccagaaccagatggattcacagctgaattatactagaggtacaaagaggagctggtaccattccttgtgaaactattctaaacaatataaaaagagggaatcctccctaactcatttgacaaggccagcatcatcctgatatcaaaacctggcagagacacaacaaaaaaaacgaaaatttcaggccaatatccctgatgaacattgatgcgaaaatcctccataaaatgctggcaaaccaaattcagcagcacatcaaaaagcttatccaccacgatcaagtcagcttcatccctggcatgcaaggctggttcaatgtacacaaatcaataaatgtaatccatcacataaacagaaccaatgacaaaaaccacatgattatctcaatagatgcagaaaaggcctttgacaaaattcaacagcacttcatgctaaaaactcttaataaactaggtattgatagactgtatctccaaataataagggctatttatgataaacccacagccaatatcatactgaatgggcaaaaactggaagcgttccctttgataactggtacaagacaaggatgccctctctcaccacccctattcaccatagtattggaagttctggccagggcaatcgggcaagagaaagaaataaagggtattcagataggaaaagaggaagtcaaaatgtctctgtttgcagatgacatggttgtatatttagaaaacccaatcgtctcagcccaaaatctccttaagctgataagcaacttcagcaaagtctcaggatataaaatcagtgtgcaaaaatcacaagcattcctatacaccaataacagacaaacagagagccaaatcatgagtgaactcccattcagaattgctacaaagagaataaaatacctaggaatccaacttacaagggatgtgaaggacctcttcaaggagaactacaaaccacggctcaaggcaataagagaggacaaaaacaaatgggaaaacattccatgctcatggataggcagaatcaatatcatgaaaatggccattctgccccaagtaatttacagattcaatgctatccccatcaagctaccatgactttcttcacagaattggaaaaaactactttaaatttcatgtggaaccaaaaaagagcctgcatagccaagacaatcctaagcaaaaagaacaaagctggaggcatcagctacctgacttcaaactatactacaagtctacagtaaccaaaacagcatggtactggtaccaaaacagatatatagaccaatggaacagaacagaggcctcagaaataacaccacacatctacaaccatctgatctttgacaaacctgacaaaaacaagcaatgggaaaaggattccctatttaataaatggtgttgggaaaactggctagccatatgcagaaagctgaaactggatcccttccttacatcttatacaaaaatcaactcaagatggattaaagacttaaatataagacctaaaacgatgaaaaccctagaagaagacctaggcaataccattcaggacataggcatgggcaaagacttcatgactaaaacaccaaaagcaatggcaacaaaagccaaaattgacaaatgggatctaattaaactaaagagcttctgcacagcaaaagaaactatcatcagagtgaacaggcaatctacagtatgggagaaaacttttgcaatctatccagctgacagagggctaatatccagaatctacaaagaatttaaacaaatttacaagaaaaagtcaaccccatcaaaaagtgggcgaaggatatgtacaaaagaagacatttatgcagccaacaaatatatgtaaaaaagctcgtcatcactggtcattagagcaatgcaaatgaaaaccacaatgagataccatctcatgcctgttagaatgatgatcattaaaaagtcaggaaacaacaggtgctggagaggatgtggagaaataggaacgcttttatactgtttgtaagagtgtaaattagttcaaccattgtggaagacagtgtggcaattcctcaaggatctagaactagaaataccatttgacccagcaatcccattgctgggtatatacccaaaggattataaatcattctgctataaagacacatgcacatgtatgtttattgcagcactgttcacaatagcaaagacttggaaccaacccaaatgcccatcaatgatagactggataaagaaaatgtggcacatatacatcatggaatactatgcagccataaaaaaggatgagttcatgtcctttgcagggacatggatgaagctggaaaccatcattctcagcaaactaacacaagaacagaaaaccaaacactgcatgttctcactaataagtgggaattgaacaatgagaacacatggacatgggtggggggcatcacacaccggggtctgtaggggagtggggggctgggggagggatagcattaggataaatacctaatgtagaccacaggttaatgggtgcagcaaaccaccatagcacgtgtatacctatgtaacaaacctgcacattctgcacatgtaccccagaacttaaagtataataaagaaaacacaaacaaaaataaattaaataaataaataaataaaagattgacaagggacagagagttgagaagcacccaagagaatggaggtttatcagtgctaaagagagttatttccaggggaaagagtgattgattaactttgttgaatgatgctgcaaaatgaagaaacatgatgactaagggatatctattccattcagcagtgtgaacgtccttaatggtctttaccaagagaaatttaagtggagtgaagggagtggaagccagataggagtagggtaaagaatggctgatgggtgaggaagtgtagccaatgtgcacagacagttcttctgagaggcttggctgtgagtatgattagagaaagggcacaatgaattattcaccacattctagaatattagagccaggggcactccttcaagattgaaatcagtatatctaggaccataaaaaagacattaaattcctagttgtactgttctgaaaccctgtatcctgagaaatgatataggctgaaatacaaaatgaggtgaagaagagttaaatataaggatgactgacctataattggatcttataaaaagctgggaatgtttggtgacatatttaatttttgagactgctccacaggttccttgataccttctcataaaacactttaaaccctttctcctaaagcatctgtgttgggtgcagctgaataattcttaaattcttatcctgcaacccagaggccaggacatttgaccattctaaggagttgattgttattacaatttttttacttctctttgcaaagctcttcataattgcttataaggaacagtgcttttaacagttttcaaatgtttggcataaagccacagctacagtgacaagagatgaggttggcttttgcagtggttttgaaaactgaacatttgtaccttcctttgaatctgtgccgaaccatcctacccgctgtgatcagtttcagcctaggtctgtcattttttttttggaaaaaacgaaagagaaaacaagatttgttctattttatgggcactgggactattgtgcagtaataataataaaagatgagccatctaaagaactgtactctctaagtctcatgtgaattttttattttaaaaatatgtggtacctgcagtaaaaaaagaggttaggtaaagcataaaaatatattattgtggaggatagagtcattctagttgttttttctttagggaactttcagattcaatcttggttgaacctattttgagttctttgattttttctgattataggagaatctgttctcctggtactgttctctatagctgtttaattacagagaaaactttcatcacaatggctctatatgctgagacaaaaatgtcaactcaagagaaaaaatgaatagtacaacaagactcctaagactcgaagtcctagttgagagggaagatcaattctgagacagaaagaatgttatgtataaaatatctaatatattttatagaataatatgcttcattatgtatactgatttgatttacttctttgaactgaattaatcttgttaaaagacactgtctagagataaacacaattcggaagcaaataaactttgtaaaacacgcatgcacactgaaaacccaatggtttagagctgtgctacccagaccttaatgtgcatagaaatcatctgagggttttgttaaaaatgcaaattctgactcagtcagaataggtctggtatggggaatgagattctagttctaacaagctcccaggtgacacagatgctgttggttcaaggaccacactttgagaggcaggggtttagaatatcttgaatgaaatgatagccatatagtaaaattgataaaatgaatttatagagttatgaggtaaggcaatcagattcataatgactgtgcaaatgttttattaatagggttaatatttaagccatctgtcgtcatttaagtggaatgagcaaatgttagttccttagatctgttggctcagcctttctgaaaagatataataacagattggtccattttatgtattttatgtctgaatataatttagtctactaataagtagactaatttgaaaggtgatgttaattgcaggttgcttttaaagttttaccatgtttttcagatttcaaggatttctcagacatgccctaattggttgaacctgacaacttcttagactttttttttttcctttcaaagggaaaaaaatcctttttttataggaggaacttaaaataattgccctacttagaaattaagaaatagaatgtgaagtttgtacttgaaatgaacttttaaatgtggattcaacataagatatattttggatcttctcaacagtgttcttttttctttcatattcctagtgcctacataataccaagtatatgatagatgctcagtaaatgtttgaatgtatggtgtggtaattttccttatgataatgtgttaattattaaatgatagctattatttatcatttgctttggtgtattttttacaagagccctatgaagcaaatattattatacccattttatagataagtgaactgaaactcaggttcagtggctttcccaggaacacaaagataagttgaaaagaaagaatttagacactccttttcttgtctgtaaaatctgtgcttctaagctctatgctgtttgccttaaaactgttaatatcttatatggaatgtagcaattcaattatgtggatgaagaattttgagattaacacacaggataaaaataacaaaaataacagttttttaatttgtttttaaggaaaatttaaaatagtaaaatagttctttgtatgcttgataattttttattgcaggcctaatgttgtgaattttactttgttgggtacagggtatctttgtatttctgtatttctgagcttttttttttttttttttttttccagataagttatttggaaacagtttgatcctttcaagttttgcttttaagctttgtcagctgggacaagagtggctgggactagggctaatttttcccacttctgaggcaaagctcttgaatattctactcaatgtaaattgttttctctactaagaacaggcactattccctgtcctgtgtgagctctggggattattcccttaaattctttcaggtggtcctttccccaccctctggcagtttccttacgcatatatatatgttgatcagtactcagctgaagcagaggaggaggttctgcaagtgtctggagttcttcccttcgtacaggtctctcttctctggtgttttgtcttgcaaactgtagctgcactgacctcctaggactcgaagcttcatctcctcaactcaattatcaccaggctctgcctgggtttatcatccttgcactctgacctggaaactcgtgccaagaagtaacctggggcagtggtaagggctcacttccttcattttctgtcatttctcaggaattaacatcctttattacgtgatacctattgacttgagagctgttgcttcctttgatttgttcagttttttatttcatttaggaggtatgaaataacctgttaaggaggtacttgttaattcccgttggccagaagaggaagtctatagtgagtcttttgattcagttccactttgtttttctactgcaggtcatcaaacaaagcattattaaattatctgctaagtacttgacattcaactaggcattagagattctatggaactgtgtgcttcacacagtcttaaaatgttatgttacttgagtacaggattacaaggataggtggggcttgatcactggagccaagattcctcctggtgagcagacaactttcatcagtcttttggggtgcttcttgaaaatgcagcttcattgttcctgtgctaggcctactgaatcaacttctggggtggctctctaattgattctatgagttgtaatcagtcttcatggcccaattctgaagaaagggtggtagggaagaggggacaattcactaagtggtactgatactatatggaactttcaatttacaaagtattttcataaacctttttccatttaattctcacattaagacttcctgggtctcattaccatcttatagacaaaaagctgaggcctaattagggtaaatagtttgccaaagggtaacataggaagtggaagaacgaattctaaaactcaggttttcctcaagccattgcttcttctgccatacaccgacacttactgcattagttatcttctcatatgcagatgtaggagtatcatcaagagttattatcctttcatgtagcatgctttttttgaagagttaacaggtaacattttgtattaggattaagataggctctgagtgacatataacagtggattaaataagatgaaagtttatgattttccgcataaaagtccacagctggtgtggcactatagtgataggtactgaggctccttctttgttctctgctgtgcatggccatggtctcacagtctgagatagaatcagtatcctagacagcttgtggaggaggggataaagaaatggacaaaggtatatgattgctgtctcttaaggaagtttcctgtaagccaccatgacactttcctagagcacagtggccagaacttagacctgtggccatcctagctgcacgggcagctggtatatatggtctgtattccacaagttcatatgtctagctaaaaaaactaagggttctattaccccataagaaggaaaaatggatattggagggtaactggcagtctgccacacagttctcttctgatctagagactgctaagaaatgaagacttattctttgagcccctggttggaataacaaaaacaactacttaatgagtaattattgtatgttaatacctagaacactgcttggcagatgcccccaaaatattaattgaaggaatgaaggccagacattctgctaagcatctgatctcacataccatttaatctttcagatgatcctataaggtagtattacaatttttattttacattttacagatgcggtaattaaatatactttttcttttttctttttttttttttggagacagagtctcactctggcactcagactggagtacagtggtgcaatcttggtttaccacaatctccacctcgcagggtcaagcgattctcctgccccagcctcctgagtagctgagattacagttgcctgccactaccgcccggctaatttttgtgtttttttcagtagagacggtttcaccatgctggccaggctgtttttgagctcctgacctcagatgatccacccgccttagcctcccaaagtgttgggattacaggcatgagccaccgcgcccggccctaattaaatatgcttctaaatggcaaaactggaatttgatcctagctgtaattccagatattgtcttttataaagtagtagtcattagtgctgttcaccaaatatgctcagattgtatattcctggcctcttgaagttaagttttttatatgactggttttggccaatgaaatgtgagcagaaccaactgtcatgggcagaagctttaagaaccagtgcatgattcatcttattctttttctttgccagtgttgcagatattggcttctctcttagcctaggtcctacagtgaaaacataggcagtgtgaggtagagtgtgaagacaggtagaataagggtggataggtaatgtaagtgagaaacctttgcttttgggggttaatttctgcagcatactgtaagctacacctgactgatatggaaatttttttttcttttggttatgtttaattgaattatgtcatgtacattgtagagtgcatgggcttttgaggaagaaccttataactgatgttctaacattttttttctatgacaaaattattagttgttctaaagcattagtttataaatgtttccaacttgggaccagtctttgttctctttcttcagtaaacaaaatcttaattttattgtgtaacagacatagttttcatagaggctatggattgtttatgaaacatgatttaaggtagaatttatttggacaaataactgaagtttttttcagcttagtggtttaaggagtctaagaagttacagtttagaatgaggcccaagagtattaaaattcattcatttttaggatttattctttatccactatgtgccagacactatgcaaggctctgtttagagatggttaaagcatctctacttaaagagctagccaattaagctcaagtacctgcttatttcaatataggtgtttttgacttcacaaatgacagcactgtatctgagaaataaagtaaggtgtttccttaactcaaatttgaaatataatttgattactggaactgttatgagcttaagtgtgctttgtgaatgaatagaagagcatgcctatgaagataccaaaggtgagtgagagttgcagagacctaggataggtttgataatgggaagtaccactttctggtatagttagtgattttatcagatttagtagtctgggaaatgtttaaaggatactttaaacatgtgggagaaatgttgtgggagtatttgttatagaaataaccagagtggccttgactggtaatttcaaagacataaggaacttattcttctgttacatggaaagtgttttgagtaaatgtagtctatttatggctactgataattcttctgttacatggaaagtgttttgagtaaatgtagtctatttatggctactgatagaggtgatgaagttaattctagtaattgggtttaaaaagactggataatttcatgatcaataatcttagggatatgtggtaaaaggggaattacatctcatgctttgatacatgagataatttttgtacattgtaaaagaaaaagttctctatatatatgattacttttttggtggtggggaaggtctgcgtgttattgctattgttttttttttattgttacagttaaaactttgtatttctgtgaaacaccaaaaaatgctgaattttattgtctggtaattggtatttggcaggaccacttttattagcataatacactctacaagtttgttgaaataatttatgagactcttgctaccaagagtcagtgggaaggcagttgatagcctacttagcaattttgcacacttttcatattttatagtgcataaaatagcaacttgagccaatatataaagctgtgacactttttgaggggtcttaaaagcagaaaacaaaacccctgatctagtacataatttaattcatcacaatctgaataatactattttcacctttcatgtagatataatttagggtaagcacatttggaatacttttctgtattttcatactcttttgacttttttctacctgatgttagatttttcttatagtactgacttgcacaaacacatgcatgtaaattttgagaagattctctgtttaaccaatatataggttgtgctattgttatttaactgatgtataagcttgtgatagggaggttccaaataaagctgtgtgtgctgctgtgttgatggcaacatactgccataggcggaggtcatattgatgtcaatgttaagctacgtttagattggcaactggaacgaagagaagatgtaaactttatgtatgttctctgtgaccccttaacattaatgtcttctgttatgatttggtcattagagataacatttttctttttctttttcttttcttttttttttttttttttttttttttaaagacagagtcttactctgtcacccaggctggagtgcggtggtgcgatctcggctcactgcaacctctgccgcccgagttcaagcgattttcctgcctcggcctccttagtagctgggattacaggcacctaccaccatgcccggctaatttttgtattttttgtagagatggggtttcaccatcttggccaggctggtctggaactcctgaccttgtgatccacccacctcagcctcccaaaattctgggattacaggtgtgagccatcgtgcccagccaacatttttctttaagctttccatattgtgttaatgtgaacatgccagtagtataaagttatcagtcattaaaggtatttcccaagggccagaaataagcaatttttttttctcagatacctggattatgttaggtgttatgatattggaatgtctcggtagaattaggacattatattcaaatcctaaatacagtatcgttgtcctttgtggtaagctgaatgcttttcttaaccttgattctacctagtcgacaaagaacatggaagcctctaacaacttgtattctaaagcatttcaaacataatcaaaggtagacagaataatatagtgatacacgtatgcatcatctagctttaagaattaccaactcgggccaggtgcggtggctcacgcctgtaatcccagcactttgggaggccgaggcaggcggatcatgaggtcaggagattgagaccatcctggctaacacggtgaaaccgcatctccactaaaaatacaaaaaattagccgggcatggtagcgggcacctgtagtcacagctactccagaggctgaggcaggagaatggcgtggacctgggaggcggagcttgccctgagccgagatcgtgccattgcactccagcctgggcaacagagtgagactccgtctcaaaaaaaaaaaaaaaaaaaaaaattaccacttacagctagtctaatttcatctacaccctatccacttccttctcatcatgttattttgaagcaaatcccagacatgatatcatttcatcagtaattatttcggttcatatctctaaaagaaaaaggactttaaaaaagcataaccataataccccaaaattaacaatttcataatattatcagtgttcaaatttcaagtagtcttacaagtgtcataattcttttaaacatggccaaaaattgtgattgattggtgtatcttttaatttttaggtttctctgcagtatttccttgacctcacctctctctcttccttgcggtttaagaaatcaggttgttctacagagtttctcagtctggattttgctgaccgccatctctgtggtgcagtttaatgtgatcctttgtgctctgtatttcttgtgaactggtcattgaatctagaggctttgtcaaattcaggttggattttcttgtattttctttatatatcatctagaatatttctgtaaagaaaaacatccccttatctattagaggttacccggtggttggtttttatagcagagctaggataaattcttgatgttttctcttcatttaccacttaaaaaatgagttaagctgggcgctgtgcttcacacctgtaattctagcactttgggaggcccaggtgggtgaatcacttgaggtcaagaatttgagaccagcttggccaacatagtgaaaccccatctctactaaaaatacaaaacttagctgggtatggtggcgcatgcctgtagtcccagctacttgggatgctgaggcaggagaatcacttgaacccacgagacagaggtttcagtgagccaagatcgtgccactgcactccagcctgggtgacaggaaaaggaaaaaaaaaaaagagttggttccctagactccttcggtgttggaggatgtttttgtttttaactagaagcttttaagatcttcttctatccatggaattcaggaatttaatcaggatatgtctagttattgattttttaaaacccccatccccattaatgcctggaacttaaaccgtttgtatcttcagtctcacttctttctgcagttgtagaatatttcattctattattttttcaatcagttcctttcctcagtctttttttctccctctactttagaccctctcactaacattttttctcctggatctgaatctttgctccgtgtatcttgttacacatgatttctttctcctagttttgctctatttttctcctgcttgctcttttaaactattaatttggcctcaatagtgtccatccaattcttcaattagctattgaaatttgtattcataaaatagttttagcttcaagattctcaagtgtgaataataattatatttatcattatttaataagaaatacagaaatatatatttattattattacagttattatttagttcaagctgttgtcagtctcctctagcagcttgttcccccgggagcctcgtgttttgggttttctgttgttcttcattgctttagcccattgggtatgtagctattttcctttgtctaacttatgggtcttttcactcctgggtgtcatctccaagagtggacactttaaggtgctgagtgttgggagatgcagaagtcacagtgctgtgggcctcctgtagagaagtaggaaggattgagttaagttggccaactcctttgtgactccttggaggttgagagaccgctaggaacttcagagcacatagtctggtctgcccatcttcatgaggtccaccaatttctagggactaggctctctcacaagaactgcagcattgtctttgcctcagggctccttgcttagtacctcctttctcctgtagggggaaaacgtcctactagctctttttttgtggaccctgagacctcaatccacccttctggctgtcttggatgatgtgttttttgtttgtttgtttgtttgttttgagatggagtctcactgtgttgcccagtctggagtgcaatattgcaatctcagctcactgcaacctctgcctcccaggttcaagagattcacctgcctcagcctcctgagtagctgggattacaggtacccaccaccacgcccagctaatttttgtatttttagtagagacagggttttgccatcttggccagactggtttcaaactcctgacctcatgtgatctgcctgcttcggcctcccaaagtgctgggcttacaggtgtgagtcactgtcccctgccagatgctggtcttaataattgcttaaggaaaggtaaatggcatttggattggatttggaaagagaagacttcagggatgcaatgaagctaccattttttcttgaaccccttggaagttcttaaaatggatattttctaactatatgagcacattatgtagaccttttggatgagggattgcaacagacatctgaaaaatcataagcctggaattctcctcccccagctacctggttaactttcatacctttggtctttgctcaagcctcaccttctcagatgcctaccttaacctctctatttatattgtaacatctgtgtcctgtctttgcactttgattccacttgtcctgctctatttcttccctagctcttagcattatctcatatactagataatttttttatttgctatgttcagtgatgtgcctagaacatctgacacctagaatgaatatttttttaacatcttcttcccctgaatgataaaattattttctgaaataatcaagttaaatgaaaaatattatgcagcggacattctctcttactgagttttgttataataattatgccaaataaataggaaaaatacagtataaggcaggaaaaaaaatccacaactatttagcccattgtttttattttattttatattgtgttattttattttattttgagacggagtctcgctctgtcacccaggctggagtgcagtggcgcgatctcagctcattgcaacctctgccttccgggttcaagcgattcttctgcctcagcttcctgagtagctgggactacaggtgcacaccaccacgcctggctaattttttcatttttttagtagagacggggtttcaccagttggtcaggctggtctcaatctcctgacctcatgatctgcccacctcggcctcccaaagtgctgggattacaggcatgagccaccgcacccggccaccaattgtttttatatctagttaactgtttgaacttggattctgcagttacagactgatattttatgaaattgttcattaactaataagtgaagtttttttaagtaaaattaagcatttccgactgggttcggtggtgcatgcctgtaatcccaacactttgggagtctgaggcaggtggatcacgaggtcaggagtttgagaccagcctggccaacatggtgaaaccccatctctaccaaaaatacaaaaaattagccaagtgtggtggtatgcacctgtaatcctagctactcaggaggctgaggcaggagaatcacttgaacctgggaggcagaggttgcagtgagccaagatggtgccattgcactctagcctgggtgacagagcaagactcccgctgggggaaggaaaacaacaacaacaaaaacctaagcatttccaaaaggtacaatttacgcaactattaataaaattgttgatatgttttatcccctcttaacgttctttagtttcaaaacacttaatttgaagagaataaatttcaatgttaaagatattgttcaaatttagtaaaatattttgtgaactaaaatttgcacttattaaataagttacatcttgctatttacacttgcaacagtgttttaaattttagacaaataccaaaaggtcccataaaaatgacagaattggagtgcctcaagttgtttcttggtctttacaatcactgtgctatctttgttttattttgaatctatcatttaaatgcacaagaatgtagtaccacagggagggaaaagccaactgcatcctaagaaagggttggattaagaacttcatgttaagcagtcttcaggtttaagaaagcctggtgcactgcttttgaaacaagtgtatgtgcctaagtttgcatggatgggggttagctgtaactgggagtttccccaatgaacttatatgtagacaacaatttaagaataaataacaaatctgatattttgaagcttacatatatattatttaaactcagcagtaactgcagtaattatttggaacttagaccaacaaaatgtttttttcaggaaggagtatttttatcactgacattgattagaattactggcacatggtggtaataaactgattttagtcagctttttaattgtttataaattctctacagaccaagcattgctttattgccagcacctgcagtgtactgctcccaacatcccacctttggtatgtcactaattatatttgttgtgtattgtctgtactcttgctctgcatcaccatttcacacttgctccattaggattaggatctgtgttttgttcagtgatactgcaatcatatatttgttgaatgaagaattaatgaagttcaagttcagagactttctatgtcttttttcttctccatattataagagggatcagtacatagtggatactttgctattgttaactcactgacttaaatgcttggcatatagtctctttggactcttgcatttcttgaaaaatttggaattttgattgggattggatagatcaacttggagaattagtgtctgtactaatttcttagtgctgctgtaacaagctataaacttagtggcttaaaacaacgcaaacattagcttatagttctagaggtcagaaatttgaaatgggtttattgagctaaaatcaaagtgtcaggaggactgcattccttctggaggctcaagaatctttttttttttttcctggccttctctaacacgtagaggttgcctgcattccttagtttgttacccaccttccatcctcaatgccagcaatcacattccttctgactctttctgcctccctctttctcttgtaaggatgcttctgattacaataggttcacctggataattcagggctatccctccagctcaagatattttaacttaatcacatatgcaaaatccctttgctatgtaagataacatattacaggttccgggtattaggacatagacatctttagggggaccgttgttctgcctattacagcattttaataatattaaatcttcctatctgtgaacaaaatatttctctccatatatttaagtgttcttaaatttctctcaattttcaatgtgctggtcttcttttgtcatatttatcccttagtattttatatttttgatgttgtaaattttgatgcttttaaaatttcaggttctagttcttcattagtgtatgtaaatgcaattggtttttatttattgatcttctattctgtaacctttctaaaattcacttattctagtaaaatcaactggattttctacatagatgatcatgttgtctgtgaataaagacagttttacttctttccaatctggatgctttttcattctttttcctgtctgattacagtggtaagaacttgcggtaacaatgttgaatagaagtggtgaaagtggacatcttgtcttgtttcttatcttagggagaaagctttcagtatgaagttagctgtagttttttttttttttttaatagatgccctttatcagcttgaggaagttacttctattcctggtttgctgagttttaaaatcaggaatagatgttggattttgtcaaatgttttttctgcattctctcatattgaggtgatcatatggtttttcttttttaatatgttaacatggtgaataactttgagttcacaatatttctgatttcccttttaatttcttatttacccatgagtaaataagaatatttggggctttttttcagagacctgtttttgatttctaatttaattcatctgtgctcaggtaacattctcttaaatcaaccagaacttgttctgtggcttagaatatagtctttgtgaatgctctgtgtatacttgagaagaatgtgttttgtgttggtgttagatggagtgttcaataaatgtcgatcaatcatgttggttgacagttgctcaagtctgctatatacttggtgatttgctatgtgctttttctatcagttattgagagaggggtattaaaatctgactgtaattgtgaacttgtctgtttccccttacagttctatcacttactgcttcgtgtatttttaagctctgtattggaggaatacatgtttgggatgattatctttcttgattaattgacccttttattatttgaaatgaccttctttgtaaccttttgatattcttgtctaatattaataaaaccactccagtttttattttttatttttatctttttagtgaaagagtctcactctgttacccaggcctctgggtgcagtgtgcagagtgcagtggtgcaatcatagcttacagcagcctcgaactcctgagctcaagtgatccttctgcttcagcctcccaagcagctgggactacaggcgtgtaccaccgtgcctggctaatttttacattttctgtagagatcaagtcttgccatgttgcccaggctgatctcaaattcctggccttaggcaagccttagactcttttttttttttttttttttttaagactccgtctccctcctttgcccaggctggagtgcagtggcgcgatcttggctcactgcaagctccacctcctgggttcacgccattctcctgcctcagcctcccgagtagctgggactacaggtgcccgccaccatgcccggctaattttttgtatttttagtagagatggggtttcactgtgttagccagggcaagcctgtgctgagattgtaggagtgagccactgtgcctggccttactctagcttttgactagcattagcttggtatatattttttctatccttttgtttttaacctgtttgtttttatatttaaagtgcatttcttgtaggcagcatatagcttgttttgtcttttttatccaatctgacaacctctgcctttaattgaggtgtttacatttaaatgtactattatatttaatatgattattgatagggttgggtttcagtctgttatcttgctatttgttttataattttcccatctgttctttgttcccttttaattttgatcttgcctttcgtttggataaattgaatattgtttatcaatataatcccatttatcagttatcttttaaagatatttaggtaaaatttttatgcatttgcccatgtaattattatttcctgcactcttcattcttttgtggagatcttagtttttatctgataacattttctttcttcctgaaggacttcctttcacatttctttcagtgcagatctgctggtgatgaattctttctgaagacatctttatttcctttgaaaattttgcatcttaatatggtgccttcatttaaaagttcttatttacttaaccatccaacaaaatattgggtgtctattgtgtgccaggtactatcctaggcatttgaatataacagtgtccaaaacggggaaaaaaaaatctctatcttcatggagcttaatttctgctcagggaagactagtaacaagtaaatataacaaagtggtaagagctatggataaaaataaagctggagaagggaataggagtagtgtggtttagataacatgggggagttttcagatggatggttaggaaaagttttacctgaaaacatgatatttaagctaaggtttgaagatggagtgagtcgtggtatctagaagaagagaatttcagatagaacagcaattgtagaagccctgaggtttataataatcagtgtgcctagtgggttcagggagcaggaaggaggctagtgtggctgatgagagtgcacagtaggtgggtgctacaggacaagagcagagaggcagtggagggcctagaccgtggagtgcgttgcaggagcttctgaatgagatagggagctattgcagggctgtaagctggaaatgacatgatctgacttatatttttaaaggatcactctggctactgtattgagaataaactctgtgttggagaagggaagcaagaacagaaattgaaaagccagttaggagattattataataatccaactagagagaatgataatttagacaagacctataagaagtggttgaattatggatattttgaagatagacatgaaggatttgctgatggattggatatgggtgtgagaaaaggagtcaagaatgattccatggtttagccaaagaaatggaaggaaagaattaatttcttaagtgttgcatatagaaacctgaaaaagaagaaaattattttctgaggtgaaaatgttgtgatgtcaaatgtctacaacagcctagcacagggtaggtactttgtaaatagtgaatgagaaggttaggagttcaagttaggggctgttaattttgagataactattaaacctttacatggagatgttgattgggtgattaaatgtagcaatttggagggcaagagagtagtctaaactggggctctcctggaagttgttggctatgatttgaaaaaaaaataatttgggaaaaatagaaatctttatagtgagtgtttctatccaacaagagacatatgtaagaatgttcataacagtattatttgtagtgaacctaaactggaaaaaatacccatcagcaaacaaacaaacaaacaaaaaaagggtggtatcatcatagaaggtattcaagaatcatgaaaatgaatacacatgcaacaacattgatggagccaaatgtcaaataattctttatgattccactcatataattaaaactaaagtatagtgttagaagtcaggatgggagattattttaagggaaaaagaagcagatagtgattttaagacagcaaacactagaggaccttctggaaatctggtaatgttctatttcttcatctgggtgatgtatttgctttgtcattgttcattgagctgtacacttatatttcggatgctttttggtatatatgttacatttcttaaaacaaaacattaaactatcatgttaacacattgccttccaaataattcattgaccagactgtagttgtgaaagctgtacttgactcctagctatgcttctggttctaactagtcattaaaacacacaggataattcatttaaactgtgacaagaagagtgttgtgccactgaccaagttccaaatactgggaaagagggagaattacaaccactgaaggaattagtgcaggtcttattgtatcccctttgatatctaaaatgttattcactttttaagtttggaatttaaaatgaattagagaaaacacagtagaaatcttggatttaaatatagcattaaaactccaaaccccacgtatgaaactataagagcattgttagtagaatgcagtaacctcataaaaacatatctaagttgaattaggtatgtgttaattattttgaactttgggcattaagatgagtctataacatcttattgtttatgtaaggatgtttaccttacggtgtttattaaggatatgaaagccacctatatagtatagtcacttaagacccagatcccactctaatgtatctatcagtcatgtccttccctgacattttgatttaatttcttcggttcctcactatatctcgataggttggaactatagatccaatctaacaagataaaatataatggggctaatccaaggttttatgtttaggttcaagatgaataaagggaagtatgatttaccaacataggtaatgaagtgtcaggaggttatattgatttaagatcaaactcttcagtgtactaccctctcaaaaagttaatgtgattataggcaatagtattgcaagtaatgggaaataattagactacaccaagcagattatggtaagtttatggcaccatattttaagagtgacactgacaaactagagctcatccaaaggaaagcaccagatgttaaggggttatgaaaaatggagggctgggtgcgatggctcacgcctgtaatcccagcactttgggaggctgaggtgggcagatacttgaggtcaggaattcgagaccagcctgacgaacatggtgaaaccccatctccactaaaaatacaaaaattaaccgggcatggtggcgcatgcctgtaatcccagctactcgcgaggctgaggcaggagaatcgcttgaacacaggaggcagaggttgctgtgagccgagatcacaccattgcactccagcctgggcaacaagagtgaaactctgtctcaaaaaaaaaacaaaaaagaaaagaaaaatggattacatggctgaagaaattgggactgtgaagtcttacagcaactctgtaaggtgctatctccattttacagaaagaatactgaggctcagagagaataaattatttattaaaatgtaactaaaaagtggttggctcaggacccacaactcatgattcttaatctgatattctttctgtttcaaaatattggcttttaattttattttttaaaagtctggctgttagcctatatatatggagaagcttaaagttgtaagggaagggttacagattaaatgaatggaaaagcaaagagaatgctcggagtaaaaagatcaatatgagaaaacacttggtcatcagtattgtaagtttatcagttatagaaatgtattatcttttacatatttttctccttctccctttcaaggtttttgattccaatgaagaatctggatatcttgttctcaccatagttatatcaggtcatttcttcattttccaaggacagacactactggtaggttttatgcataacagtttaatatggaaatacatctttgtcttcttagctttacatgaatttttgtatcctcaagcttcttcagtctcactgtaattcatcaaggtcaacacattaagcatttatcgaatgtgccataatagtgggaaatacagaaacgtactgaatattgcctgccctaaaggggtttaggattttgttgggagtcagagtggatcaaaagattgaaattaaccagtatgataaaggattctgtagtaagggagattgagttaagataggcttgttaacaaagacaagtgtggagggttttccagatagggaaaacagcatatgcagagggatagatttgcagaaataaagaaaacaaaaaggtgttactgttaattgatagcgtcctctataaaactctaattttatggtgatacatgtgttctttattctgaatatatgtacactttaggaaattttggaatgaagaaatatgtaaagaaaataagaatcaacttggttgaaagtttaggttttatttggtacatagaaaccaaatgaaagaaaaaaaacaattggtaacttccaatcaaaggaattgtacaagaaaggaacatataagggaaagttattatatcatttagctgtgaatggggtctacattgacataaattcatacaacaaatatttactatctacatgggcataatttaacaaatatttattgagtaattgtatatgctaggcattttaggggatgctagggatatagcagtgaacagtgaagacagaaatctctttcattatgggatatcatcattctagtgggggaaaaacagcaataagcaaataggtcaagtacatttaaaagacattaattctttttggatcacttacatgttctatcataatatggtaggatctcacatgtgtatgttgtgatgattcatatttccgcttaaatatagccttctcattgaacgtgagatgacctgcaaagtcatctttgtattcctcgtgacttttaaaactgcagcatgcgttgtactattttgctttatctgctactgtcagggtctgcatcagttgcaagagataaaggtttcttcagctgctaatgagtgttgcaaatggtagacttgaagaatacctagtgcacagttagttctccctgccaatatcatgggtctttgctgaatggtgacattaatgcagtttggcttcctcgggcatattagaccaccccatactgtgtctctgctccatctttttgccccagtggtgactattatgaacaaatggatagaaatttctttgtatcacacatagaatgatttttgcactgtagtcacaaaaccaagttatcaaattccaagatacccactacagagaaatgtaaggataactctgcaatttggtgcatgttgcatatacagtcatgtgtctcatcacaacatattagtcaagagaggaccacagatatgatagtgatcccattagattataagggggctgaaaaattcctatcacctgtgatgtcttgatgatactggcccttgtaggcataggctaatgtgcatgtttgtgtcttagtttttaacaaaaggtttttaaaatacaatgattttaaaaatgtaaaactagaaaaaatattgtatatgttttaagttattgtaaaacagtccaaatgttttttaaaatttttttgaagtttataatgtaaaaatgttacagtaagctaaggttaatttgtgattgaagaaagatactttttaaaataaatttatttataaaaaatagtcattaaggaaatgcaaattaaaaccaccatgagataacaatacacacttaattaggatagttaactgagtgtacagtgtttataaagtctacagtagtgtacagtaatgtcctaggccatcacattcattcaccactcactcacccagagcaattttcaccttgcaagctacattcatggtaagtgccctatacaggtgtaatgtttactgtaccttctctatgcttagatatacacatatttagcattgtgttagtgttacggttgcctacagggttcagtacggtaacatgctttacaggtttgtagcctaggagcaataggctatcccacgtgacccacatatgtagtaggctgtaccatcgaggtttgcataagtgtactctatgatagtcacacaatgacaagatcacctaatgacacatttcttagaacatatcctcattgttaagtgacatatgactatacatatataacttaaatattgtaatttgtttaatcttttttaaaattatttttaaaaatcacttttattgaggtataatttacataaaattcactgactttaagtgttcaatttgaagtgttttaataaatctatagtcatgtaaccatcgccacaatcatgatacagaacatttcaattaacccaatttccttgtggctctttgcagtgagcttctctgcccaccctcagcacctagaaaccattgatctgctgtcactctagttttgccttttttaaaataatttttgtttatatatatctttaattgacagataaaattgtatatatttactgtgtacgttattttgaagtatatatacattgtaaaatgactaaatctagctaattaacatatgcattacctcactgtagttttgccttttctagaattcatgtaatggaatcatatgatatgtagtcttttcagttgggcttcttccattcagtataatttgagattcatctctgttgttccatgttatcagtagtttattccttttcattaatgaagaatattccattgcataggtaaacctattttgcttatccattcaacttttgatagacattggggtggttttcattttttcagctgttatgaataacactactgaatatttgtatacgagcctttgggcatgttttcatttttcatcgttaaatgtccaagagaagaaccgctgagtcatatggtgtgtctgtgtttaactttataggaaactgcaaaactgttttccaaagttgcattctcataagcaacgtatgagggttccacatgttccacatcctcaccaacacttggtattgtcagtctttttaacttatctatcctaataagtgtgtagtattatctcatggtggttttaatttgcatttctttagtgactaatactgttgagcatcttttcacgtatttgccatttgtatgtctcattggtgaagtgtctgttcgtgtcttttaaccattgagttgtttgccttcttatattcgaatttaaaaattcttactctggttacaactcttttatcagaaatgtgttcttcaaatatttctaccagtttatagcttaccttttcatttctttgtgtcttttgaagagcagaagttaaaaattttgaagttcaatatttttttctcttatggtttatcctttttgtatactacttaggaaatttttacctatgccaagattgcaaagtcattttttttgagtcaggatcttgccctgttacctaggctggagtacagtggtgtgatcatagctcactgcagccttgacctcccaggctcaagtagtcctcccatctcagcctcctgagtagctgggactgtaggcatacaccaccatgcctggctaatttgttatagtttttgtagagacaggatctcactatgttgcctaggctgctctcaaactcctggactcaggcgatcctctcacctcagcttcccaaagtgttgggattataggcatgagtcactgtgcctggctgcaaagatttttaaaaatgttttcttctagaagctttatgctttcagctcttatatttaggcctctagttcattatgaatttttttagtattaatatttttatttttatttcatgtagtggtccttctttcccacaattaaagcaatgtggtattgataaaaattactatattatggaatgtaatcatggatcttaggcaatttacttctggaaccattgaattaattttaatatatggtgacagttaagaatttgggtttattggccgggcgtggtggctcacgcctgtaatcccagcactttgtgaggccaaggtgggtggatcacctgagatcaggagttcgagaccagcctggccaacatggtgaaaccccatctctactaaaaatataaaaactagcctggtgtggtggtgggcacctgtaatcccagtgactcgggaggctgaggtgggacaattgcttgaacccaggagacagaggttgcagtgacccgacacggtgccactgcactccagcctcagtgacagagtgagactctgtctcaaaaaaaaaaaaaaaaaaaaaaaagaatttgggtttattttttgcacgtggatatcgattattttagtaccattaattgaaaagactagctttctctcattgaattacctgggtatcattgtttaaaattaatttgctaagtatgtgttagtctatttctggactcttttttgttctgttgatctatatgtctatccttactccaataacacactgtcttctgctttgttgtaatttttgaaatcaggtagtttaattcttccaactgtgttctttttcaaagttgttttgactattataggtcatttgcatttccatataaattttagaatgacatttcctacaaaaaagcttgctgggattgtgatgggactgatttgaatctataaatcaatttgagaagaattgatttcttttaccatcttctaagtagtgagcatatttaaaactctccatttattgatttctctcatcaatgttttgtagttttcataatacaggtcttgcacatactttgctaaatttatccacaaatatttcatattttttatgttcttgtaggtaggattttaaaatttcaatatctaatagtttgttgctgatgtttagaaacataattgatttttaaatattgaccttgtatcctgtgatgatcttgctgaactcattagttctgcagcttttttgtaaattctttagggttttctacatacatgatctgtgttctgtaaataaagatgttttacattcttcctttcaatctgtatactctccctgcctgcctcacccgcttcccacagattatgctggctaggatgtccttttcaatgttgaatagcaatggtgagagttgatgtccttgccttgtttccccatcttagggggaaagcatttagtcttttcaccattaaatataatgttagctgtaggtttttttttttgtagatccaattcataaaaccagggaagttcccttctattcctagtttgctaagggacttgttttttccctttgagcttctggtatttatctatttttaaataaaaattatatatattaatatacatataattaaggtatacaatgtaatgttttgatatacattgtaaaacaatgactgtagtcaaacgaattaacatatcgttacctcacaattaccattttatatatgtatggtgagaatatttaagatctattctagcagatttcaaatatacaatatagtgctattatctatatttatgctgtacattagatctctagaatttattcatcctatataactgaagcttcataccctttgaccaacatctcatttcctctaccttccctggcccacccctagtaaccactattctattctctgcttctatgaattttactattttagatctcatatataagtgagatcatgtaatttttgtgtgtgtctggcttatttcacttagcataatgtattccaggttcatccatgttgttgaaaatggtaggatgccttcttttttaaggctgaataatattcatgtgtgtatatgtacctatatacataacaattttttatccacttatccactgatggacccttaggttatttctgtatctcgactattgttaataatgctgcagtgaatgtggagtacagatacctcttcaaaatactaatttcatttcctttgggtatatacctggaagtgggattgctggatcatatggtaattctatttataattttttgaggaaactccatactatttcccaaaatggctataccaatttacattaccaccaacattgtacaaggattgctttttctccatattctcaccaatacctcttgtcttctgtctctttaatagtagccatcctaagaagtatgagggaataatgtcattgtggtattaatttgcatttccctgatgattagtaatgttgaacactttttcttatacctgttggccatttatgtcatttgtggaaaatgcttattcaggtcttttgctaattttttttatttttatttttttgaaatggagtttcgttctgtcacccaggcttaataataaataaattatttaaataaacaaatttatttaaaatttttaaattttataataaaaattttcaattactgaatcaacctttattgtagaagtatttgattttttaaattatgtacatatgtaagtgtgataaaaataagaatacatatttaaaatatattttgccccctaaattacagaataattttcatcagttcatgccatttattcataatctttcttggcctccacagaaagcaacacgtagaagagcaaacacatttggattataacgcatttataacatgtgtaattttatgttggtattacatttacacaccctctcctttcatactaatctgggtcatgatacatttttagaacttttttttgagatggagtctcactctttcgcccaggctgggatgcagtggtatgatctcagctcactgcaacctccgcctcctgggttcaagcgattctcctgcctcagtcttctgagtagctgggattacaggtgcccaccaccacacccagctaacttttgtatttttagtggagatggggtttcaccatgttggccaggctggtctcgaactcctgacctcaggtgattcacccaccttggcctcccaaagtgctgggattacaggccaccgcacctggccttagaacttttttcataaaaggtagagacaggacagccatagaaagttttagccatttctgtcttagtacaattattcaatcactggcgtgaatctaaatatcatatatttatattttcaaagttgtgtggaagctgcatccataaaacccctccaaaaagtagtaacagcctagtaacagcttcatgtgtgtgatatgtttatgtaaaactcaaaacacgtcaacatggttttgggctttctgcttggtcctgggaagttatttaaatttaatttcctttaaccatcataggtctttgattgccactccctgtgagatccatgggaacttaatgcttcagattaaactgcatgcatggtatctagtaatactacagatttccatcttgcttgttcatatagcacctgcattcaactggggacatcactgccagagggctccatggagacataccactagactgttctattgtcatttatgtcaaagggttaatatagcaagaaggctgagatatcttgaccccatcctcagtttaccttggacttgggctcaactgactttcccttgctagtcttgagagtttgaacagattctcccttggccgttttgggtttcacattttttttttccctaattgtggtaaatacatgtaacataaaatttaccatcttaactcccttttttttttttttttttttttttttgaggcggagtctcactctgtcgcctaggctggagtgcagtggaacagtctcggctcaccgcaacctctgcctcccaggttcaagcaattctcctacctcagcctcctgagtagctggaattacagctgcacaccaccacgccaggggctaatgtttgtatttttagtagagatggggtttcaccatgttggtcaggctggtctcaaactcctgagcttgtgatctgcccacctcggcctcccaaagtgctgggattacaggcgtgagccactgcgcctggcctatcttaaccatttttaagtgtacatgtcattgacattaagtacattcctatcattgtgccaccagcagcaccatctatctccagaactcttcatcttgcaaaacgaaaactctgtacccattaaacaactgcccattatttttcccccaagcccttggtaaccaccattctactttcagtttctatgaatttgactattgtaggtacctcatataatggtgatatagtttggatgtttgtcccctccaaatcttgtgttgaaatgtaatccccagtgttgaaggtggggcctgtaggaggtgtatccctcatgaatggcttggtgctgtcctcacgataataagtgagttcttgctctgagttcatgcaagatctggttgtttaaaatagtgaggcacttcccccttctcttgttcctgttcttgccatgcgacatgcctcttccccctttgccttctgccatgattgggagcttccgaggcctcaccagaagctgagtagatggtggtgccatgctttctatatggcctgcagaactgtgaaacaaataaacctcttttcttcataaattacccagcctcaggtattcctttatagcaatgtaaaaacagcctctaatacaagaggaatcatacagtatttgtcattttggactgtttcacttagcataatgttatcaagattgctccatgctatagcatatcatagattccttcctttttaaacagaataatattctactataggtatatactacattttgtttactgatttatctaccaatggatgttcagttgttaataccttttgcctattgtgaataatgctgctgtgaacatgagtttacaaatatccctttgaaaccctgctttcaattaatttggatatgtactcataagtagaattgctggattatatggtaattctatttttgatttttttttttttttgaggaactgccatactcatttccacaggggctgtaccattttacattcctagcaatagtgcatgacagttccagtttctccacatccttgccaatgcttattattttctgttttttaaaatagtattgatcttagcgggtgtaaggtggtatctccttatggttttgatttgtgtttctctaatgattagtgagattgagcgtcttttatgtatttgttgcccatttttgtatcttgtttagagaatgtctattcagttttctttttcaaaaaaatatttaacagtttattttctttgagtacttctggtcaggctttggcagggctctctggattcctctggtcatgttttgagctgccgctgctgctgctgctgctgctgcaacttttaaaggctgtttttgcttcttcagcttttgagtctcttggaacatccagaacgcacagtcttctcagtcaggacttggcaatgggctgctccatcaaaaagatgtgctcagtccccagtgtgtcttctcagagacatcatattggtctaacgaaggtttttgagcatctttttcctctggacagtgcccatcaccaatagtatttgtgggttttgttatttcagtgtttctgctgtgttcttcataattgtgggctttggtcaagggaataattcgagcctccaggaagctggtgtccttagggtttgccacgactttgttcatcagatgttcttacttgatatttagcttctccttttggttggtcatttccaaagacaaggatcttttcactgtatcattgcccttctcaattccagggatggtctggtggtctttgagcagcatggaaaggggaaggtcatggtcctgtctaggccagactggtttctggatggtgtatctgctgcagcctggaggaggagactgcaggccccttcagttggaaggaagcctggcattccctcagcccagcagcccaaggactggggtctgggtcactgcctgggtccaatagaactcggcactctctatgtggccctcagcatggtgacttctgacccccaccaactcccctggggcctactccacagcctccagccccttcactgtagggactgggttacacaggcctcttcaattttctgattggggttttgttgttgttgtgttgtggaattggtgttgtttttttaaaatgataattcccctttacacacacacatgcatacacatcctccacctagtgaatgtagcttttaaaacatttttggccagatctcatgtgatcttctccactcctgtttcttctttcagcttggatgaggtgtaggataagcactatgagccctttttagggtagggactagaaagtgtggcttttcttggagcacagagctctgtgccatgctgtgccctctccccagtcacccttatatatcaagttgcttctgccacctgcttctttgttgcctgctcaatcctcctcggcttcttctgtcctggagctggagcttctgattattagcaggaggtacacttactcttcagtgggctgccatcttttcctggatctcaaattcattctttaaaaaagtggaattcgtaactcctttggggatatttctccaaatttaaaaacacattctcttacatatcattgtaaacctctaaagatctaccttttgtcagcatcttccttctcaatccagaagttgcagaagccaaagtttcaagccaggttctaaatatatccaaatgggagaagttatttcccaaggctttagcctctatttccagccattcctttttatctcagttggctttggtccagcatgagtgtctttacctagatataattatgcctgaaacacagaatggttttgagacaattttaattctgtttgtctggaaaacatgggtcattctagaaatgatagagttcagcaaattttggttttagtttcctttttatttttcacacccggcccaaatgttcttccaacaggaattgtctttctgtttaccagtgaaaatgctatattcctatttaagtgaactctgaaacctttaaacactaattttaacccaattagtttttaaaaatgtccaaagcagtcttaactacagaatcttctaaaaggaaagatttagcataaacttttaaagtcaagttattcataccattaaactatttatttaatatttattttgagatggagtctcactctgtctccactgcagtggcacgatccctgctcactgcaacctctgcctcccaggttcaagcgattctcctgcctcagcctcccgagtagctgggactacaggtgtgcgccactacgcccagctaagttttgtatttttagtagagacagggtttcaccgtgttggccaggatggtctcgatctcttgacctcgtgatctgcctgcttcagcctcccaaagttctgggattacaggtgtgagccaccgtgcccggccaactgtttaaatcagaacctgtctattctttggccactgatatggtttggatctgagtcctacccaaacctcatgttaaattgtaatccccagtgttgtaggtggggcgtggtggaagatgattagatcatgggggtggtatctcataaatggcttagtactaacctcttggtactgtccttgagatattgagtgagttctcgtgagatctggttacataaagtgtgtggcgcttgctcaccaccttgctcctgctcttgccatgagataagctcctgcttcaccttctttaagctcccagaggcctccccagaagcagacgctggtgctgtgcttcctgtacagcctgcagaactgtgatctagttaaacctcttttctttataaattacccagtctcagatattctttatagtaatgtaggaatagcctactacagccactttttcaggaaagaatgagggaaacaaagctcttcataactttatcaccccctcccacatttaaaaccactgtgatcaatttaattccacttttgtgtgttttgttatttctcttataaagacagttgggttagcaagagttaaagcattttactgttctacgtttatactgtcctacatctaaataaacttcagctcttatgcaatacttgcttgcaaatttgctgattactcaactggaagaaatatgaggcgaggcaatcttccaccataccttttttcctttttttttggaaatggaatctcgctctgtcaccaggctgaagtgcgatggcgcaatctcggctcactgcaacctccatctcctgggttcaagcgattctcctgcctcagcctcctgagtagctgggattgcaggcacgcaccaccatgcccagctaatttttgtatttttggtagagacagggtttcaccatgttggtcaggctggtctcgagctcctgaccgcgtgatctgcccgtcttggcctcccaaagtgcttggattacaggcatgagccactgtacccggccaccatacctttcttatcttcctggcttttcagctccctttgggaatctgcgatgtgaaaaaccagggaataacgccttaagctatcttacctttccctcttttacccattgggctcaatttgtcagcagggagttcttagtccatttgtactgctataacaaaataccatagactgagcattttataagcaatgcaaatttatatcttacagttttagaagctgggaagtctgaggtgccagcaggattcgtgtctgaggtatctctacttccaaatggtgccttgttgctgcatcctccataggggaggactgcggtatccttacatacagaagaacataagagaggtactctattctggctgggcgcagtggctcatgcctgtaatcccagcactttgggagactgaggtgggcggatcacctgaggttgggagttcgcaaccagcctgaccaacatggagaaaccccatctctgctaagaatacaaaattagccaggtgtggtggcacatgcctgtaatcccaggtacaggagaatcgcttgaacccaagaggtggaggttgcggtgagccgagatcgcaccattgcactccagcctggacaacaagagcgaaactctgtctcaaaaaaaaaaaatactctattccctgaagcccttttctaaggaccctaatcccatttatgagggccctgccctcatgacttaatcacctcttaaaggttctacttctgtatactatcatattggcaattaagtttcaacatattacttttgaggaatacattcagaccatcaattccacccctgttcccaaaattcttgttctcacatgcagaatatattcattgcatcccagtacccccaaaagtcttaacttgttccagcaccatttcaaaagtcttcaaagtccagagtctcatctctaaatcagatgtgggtgagactcaaggtaagattcatcctgaggtaaatttcttttcagctgtgagcctgtgatatcaaacaggttatatccttccaaagtacaatggtgagatgggcataggatagacattcccatttcaaaagagaagaaatggttaggaagaaagggataacaggttccaagtaaatctaaaacctaataaagcaaacattaagtcttgagagtaatcttctttgacttcatatcctacttttgtacacactggggtggagttgggctccaagggcctggaaggccctgcccgttagaactttgtgagcacggcccacacagcagttctcatgcgttggagttgggtgcctgcagctcttccaggctaagatcacactctggtggctctacagttgtgagatctcaggagtggtgctgctcccgtggcctcactagacattgccctaatagggagtccttgcagtagccctgcatccgtggcttcactaggcattgccctggtgggggctatctacagtggccccaccatgtggtatttttttttgcctgggccctaaggctctctgagccatcctttgattctaagtaaaggtagccatgcctccacagcttgtgcaccctacacacctgcagaattagcaccatgtggatgctgtcaagatttatgtcttgtgccctctggagtggtggccagagctgaacttgggcccaccttagtcacagctggggtggtcaaggaacactgcaccagaattctgggagcagagacttgaggcagcctggagcagtgagcaccaaggtcaatgggcactctggggccctcccttaaaactgttctgccctcaaggctctggcattgtggacctatgatgggtgtggtagcctcaaagttctttgaaatacttttggggttattttcccattgtcttaatgaattgtatctggctttcttctatccatactattctttttatcaaatagttgcttggccatacctttagggttttcttccaaacactcttttatattctttacatggccaggctgagaattttccaaatctttatgttctgcttccatttgactataaattccatgcttaattaatatctctcttcttgcagtttattataagcagttaagagagtccatacagcacctagagtattttgctcagagatttcttctactaaatattctatttcattgcctttaaattctgccttcctcaaagcagtgggacacaaacacaattcaaccaagttctttgccattgtataacaagaatggcctttcctccagtttctaataagatattatttatttttgtataagaccttatccaaatggtctttactgtccatatttctaccaacattctattcactaccacttagattatctctaagactgaggctttctttatagccgtcctcttctaagccctcacctgaatcatctttaatgctgtgttcatagcaatatgggccttttccagcattcacttcaaaactattccagcctgtacccattacccagtttcagagccacttccccattttcaggtatttgttatagtaacacccctttcttggtaccaatttctgtcttagtccatttgtgcagctataacaaaatgtcacagactgggtaatttataaacaatagaaatgtatttcttatagttctggaggctggaaaatccagatcaaggcaccagcaggattggtgtctggtgagtgctgctctctgcttttgagatggcatctttttgctacatcctccatagggaaggaaaactaagtcttcacatggtggaagagcagaagacagtgaacccattttctgaatgcccctcccccacctttttttttttttttttttttgagacagagtctcactctgttgcccaggctggagtacagtggtgtgatctcagctcactgcaacctctgcctcccaggttcaagcaattctcctgcctcggcctcctgagtggctgggattataggcaggtgcaaccacgcccagataatttttgtatttttttagtagagatggggtttcatcaacatggtcaggctggtcttgaactcctgacctcaagtgatccactgacctcagcttcccaaactgttgggattacaggcgtgagccaccacgcctggcacctggagccctttcctaagggccctactcccattcatgagggttctgccctcatgacttattatttcttaaaggcccacctcttaattctattatattattattaacttattatgtaaaggcccacctcttaattctattatattattattaacttatgtaagtttcaacatttgaatttaggggaacacgttcagtccatagtgaggggagagtctgtgcactcttacatggctactccagaaaaaaaaaaaacaaaactcaactctctaatcacccagccttcctcaggcagcagttcccttatttgcttcctagcagtccttccaaactctaacaacagtggtggtttatctgtgccaatctcatgtctgatgccaactgtagcatttcaggtagtggaaggagtgagtacactcaaacacagtagagttccttgcttaattgtaaatgtggaatcttttgagagtgaggtgaccacccatgactggaataggtacagtgaatctcaggatagcttttgctaaccccattttctgatgacactttgctaggctgtagcccttatatacttgggacctaggtcaccattccaaaagaatttcactaatagcttctgattaagagaatgtttataagcattggatttacatctgcatttttttcaaagacagaaagttgtcagtgctcagatgtccatgaaattattcttttgccaagcttttcagcattctggaaatccacagtgctcttcacattttctgttgggatactaaggttttgttatgtattattggaattatctctatagaataagaatattacgtctttgaatatatgttgaaatagttttgcgtggtttgtcattgactattcttaaaatgagttttattagagtacaatttatatataataataaagtatctgggcgcagtggcccatgcctgtaataccagtgctttgggagggtgagacaggagggtctcttgagcccaggggttcaagaccagacctggcaacataatgagaccctatctgtacaaaaaattagccaggcatggtggcatacacctgtagtcccagctattcaggaggctgagttcagaggattgcttgggagatggaggctgcagtgagccctggtcgcaccactgtattccagtctgagcaacagagcaagaccttgtctcaaaaaataaagaatgtatatatataatatactcactgagttcattgaattttgataaatgtattcaactatataaaccatcacaatcatgatatgaacatttctttcattccttcgcccccaccaaaaaaaaattccctcttacttgcccaccttcatccccagagaactactttctgtctgctttctggcactacagattagttttgcttttgctggaaattgattaaatgcaattattgtaatatgtgctctttttgtgtctagcttctttaattcagcatgatgtttttgagccttatccgcatcatgctgaattaaagaagaacatcgtacatgttctttttttgttgatttgtatttcattttatggatgtaccacaatttgctcatctattaacctgttggatatttgggctatttccagtttggggaaattatgagtagagctgttatgaacatttatatataagtctttgtgtattatcttaattttgtgtatttgtgtattatcttaattttgtgtattatctttgtgtactatctttgtgtattatcttaattttttgtattatctttgtgtattatcttaattttgtgtattttcttaatttctttttgtatatataagtatttgtgtattatcttaatttctttgtgtactatcttaatttctttgtgtattatcttaatttctcaatttgctcatctattaacctgttggatatttgggctatttccagtttggggaaattatgagtagagcttttatgaacatttatatataagtctttgtgtattatcttaatttcttttgggtaacaccttagagtagaattattgggttgcccagtaagtgtctttataagaaagaagtaacttcaaaagaaacttctgtacagtttttcaaagtgattgtatcagccagatgcaatggctcacgcctgtaatcccagcactttgggaggctgaggcaggtggatcacatgaagtcaggagtttgagaccagcctgaccaacatagtgaaaccttgtctctacaaaaaaaatttaaaaattagccaggcccggtggcacatgcctgtaagcccagctacttgggaggctgaggcaggagaatcgcttgaacctgggaggcggaggttgcagtgagctgagatcatgccgctacactccagcctgggtgacagagtgaaactctgtctcaagaaaaaaaaaaaagtgattgtaccattttgcttttccaccagctttgtttggcagttcaagttgctctataatcttgctaacagtggtactgtcagtctttataatttaagttattcttgtgtgtgtgcagtggcatgtcattgtcatttagttctcattttctgaatgactagtgaagcacattttttatatgcttattggcctcgttaagaaacagaacattttcagtatcccagaaacctttctcatattcccttccagtgactactacacaccccactccgcaaagactaaccaccatctgacttctaatagcatagtttccctgtttatgtactttatatgaaatgaataatacaggactctcctgtctgccttcttttgctcatcattatatttatgggacttgtccatattatatttatgggacttgtgcaaaatgagattgttcattctcattttgtgaatatataacaatctatccattgatgggtgtttgagcaatctcaaatttttagctaccacaaatagtgcttctgtgaacactcttgtatatcttttggtggacacttgtatgtgtttttgttgggcatacaactaggagtggaattaatgagttatagggcagcgcttctcaaacattaacatgcatatgaattatctgggctcttattaaaatgttgattgtgaatcaccaggtctgggatgtagtctgaaattttgcatttctagcaaactcttgatgatgccgattatactcatctatgaacacactttgagggacaaagtcatagagtatgctttggtaggtattgctggagttttccagagttattctgctcaatttatactcttacaaataatgcatgagagttctccacattcttggctatacattcctgatattttctttttagccgttttggtaggttttcatttatattttcataattaatagtgagtttgaacacttttccttatgtttattggccagctggatatcctcttttgtgaagtatctgttgcaatcttctgcacaattttctcttgggttatctttatgtagtttttatttctgccattttttttactcttctttatttttttttatttttatttatttattttttttgagacagagtctcactctgacactctggctggagtgcagtggtgtgatcactgctgactgcagccttgaattcctgggctcaagaaatcttccagcctcagcctcccaagtagctgggactataggcacatatgccaacacacccagctaatatttctaatttttagtagagatgagatctcaccgtattgcccaggcagctgcttattcttttatttcttcaagctccttgtttatttattctttactcttagtgaaatctctgactgttgcttattatctgatctttactctcttgtttcaaagaatctgcatttttctgaatttagtttttttgtggtgcaattttaattaaaatttacttctatttccagttttgtttgttttcaaaactatgcccttttctgtatcttgagggttaagttttcccctttcattttgttgcagaatgttttcatagatctattattttttctttttttcttctttttattttatttatcctcatgcatggagatgtctcatatgtagaggcctgagggtggattcatctgcaataacctcactgtccttagaaactaatagtttcctttcaaatattacataagagacctggctaatataagtttacatttctgttcattgatctagaagcctgagaggagtgaacttagagcctgtcctagcaaaggagttatctctaatttcttctgtaaggaatcagttttttgctagccacaatgccagttgaatactgtagttattcatccacccttctggtatatctgcctattatttctcacacaaattttttatttctccgattattatctggtacgctgcattacacattctagggcacagttatttcagatgatcttgattagtagtggtgaaacagattccagatgagggctttcttattttttctatggctcccctattcagtagctcttgctcctcttggtaatggtgtttctgccagtgtcttctctttctctctgagtcacagaactcctttctcaggaaggtgcatcactagttggctcttggcatctttcttccatcacaataccatgtcttgcataaattcttcaacagttttgtcatatgaatggcatctagtcctagtttctagtattgatatagttctctactattttatatttgttttggcattttcattttgataagatgaaggtatgagttaaaagttcaagatacaccctggaggcagagattgcagtgagccgagatctcgctactgcactccagcctggtgacctgtctctactaataatacaaaaattaactaggtgtggtagcacgcacctgtagtcccagctacttgggaggctgaggcaggagaatcatttgaacctgggaggtggaggttgcagtgagcctagatcatgccacttccctccagcctgggtgacagaacaagaccctgtctcaaaaaaaaaaaaaaaaaattgaagatattttcttacctcaaagtctaaaaccctttaaattatttttctttttttctaaaatgctttaagtattaaaaagaaatgtaccttttctcaccataggataacagttatgcagctttctgtgacgtttggttgttcgtggtatctcagatgatgttacatttttgcaattggttgatattctataagtgggccagaatatccaaatatacatcaagaacatttatgtagatgtaaataattcactttctatagtggatcagacagatgagacactctaattgggtagctaaaatggagatctttgacctaagccttgttatactaagtgtttaatggaaagttagcgtatatatctagcttcactaatatggtaatagctctgatagggacccgaagggcttatctagcctggtttgcttttaaaactgcaattacacttttgttttgttgcacttacattgtgacttttatatgaatttcttgtctctctttcattagggactaattcccgacaatttttaaaagagattctgctttgtatttagtatgaaaatcttaaccatgtgaagccagtaataccattttatttcttctcctcatcttttctcttctctctaaagtgagtcaagactttggaataatcttttgaaagggtactaactactcacaaagagtaattttgacactttaaacctaactgcctttcccacccttcttttttcatttcctagcatattggagtcaaagacatttgccagattgtgtagactgtctttatttttagagctcttgtttactttactagatttgtagtttcgaaaaaaaagtacctcttcggggctaagttctggttggttccttttgggtatgttgaaagtttgcatcaatatgtagcttactagttatctctgatatgttctatcctcagtgtcgtaacccaaaacaaaacataaataccacagtcttaaaatattttgcactgccagtcttaaaaaaaaaaaaaaagcaagagaactttttttttgctgtgacaaaataagtcttgatttaatttatatccctatttatcatcttatcaaattacaggcataagaagcttagttatagtacttagccagacctctagattccttcttttattaagaggctatagaatttagggtcttttcaaaaacacatctttggtataagatttttttctcacagtattcaattaagtctgtactaggttcaattggattagctttacttggattcctttaaaatagtaaatcttcttattgttggagaaaaattgttattttttatatcactaatcattaatgaaagggaaatgagcacattttactttgactattactaattaaactcttcttaaatctttaatatttgggaatatttaatccttcagtggaccttattgagcagataaaatttatacacttgaaacaaagaaagtgcagttccaaaagatgggaaagatgctctagcagcataatatttttttatttaaactttttatttagaaatagtttcagacttataaaaaagttggctgggtgcggtggctcacggctgtaatcccagcattttgggaggctgaggcaggcagatcacgaggtcaagagattgagaccatcctggcaaacatggtgaaactccatctcgactaaaaatacaaaaattagttgagtgtggtggtgaacgtctgtggtcccagctactcgggaggctgaagcaggagaaatgcttgaacccgggaggcagaggttgcagtgagctgagatcgtgccactgcaaattcagcctggtgacagagcaagactccttctcaaaaaaaaaaaaaaaaaaaaaaaaaaagttgcaaaagtaggccgagcgcgtaatcccagcactttgggaggccaaggcgggcatatcacttgagatctggagaccaccctggccaacatggcaaaacctcatttctacaaaaaacacaaaaattagccagacgtggtggcggacacctgtaatcccagctacttgggaggctgaggcaggagaattgtttgaatccgggaggtggaggttgcagtgagctgagatcacgcaactgcactccaggctggatgacacggtgagactccatccaaaaaaaaaaaaaaaaaattgcaaacgtagtataaggaatgtgtttataccattcacccagctttcccaaatgttaacatttagcatagaatggtaatccaaaccaggaagttaacactaacacaatactactaactgatctacagaccttattcaaaatttgaagttgtcatactgtgttttttgctggttcaggatctaacctaggattccacgttgcatttagtttttatgtcttcttgggttccttccatctgggatagctcctcagtctttatttttttttttttttaataactttgacacttttgaagagtactagccagttaccttgtgaagtgtctctgaaagacagaagagatgttcagttcattatctcaggaggtatatgatattgatatatcttgttactagtaatgttaaccttgatcacttggttaaggtgatatctgccagtttgctccattgtagttactccttttccctttgtaattaacaactatgttgccagaagatattttgaagtatgaaaataccttctttctcacaatactcttgtccactaattttagcatcaattggtgattcttgcctgcaacagttactgctctggtgtttgccagatggcaatttcctatttctgtgattccttctgcatgtactaattggaattctactgtaataaagggctgtcccttttcccttatttatttatgtatttatttgattctatcagtatggactcatagatgctcacttcattctgtaggttatccatcactatcattatctatcactatcactaatctcccactgatcacttttctttagtcttttagtctctagcagcatgctatcagttagaatatcagggttcttactctaacttcctatgtgccatgaaattcacctttaggcaaaatattcaactattgttaccctgagtgccctctctcataaaatgggaataatacctgcttgtggtatataaatagatttgtaaactatagaatgtgatacatatagtaatattgtcattattttattgctaaatgccacaataggtattcagagaacaggggctcttttcaggggctgacttaagaattaattcttttagagtgtccacttatttctatagggaggcccaagaatgaaagtggagaggaacagttgtatggagatgaaaggcagaaggaagccaaaagtaagtcacagaaacacagagcagcatttattttcacattctgctgtgtacagtaaataattactgaattccctagaatatcatgcaatagtaatctatttctttgactattagttttgaaaattcccttgtttcatgtaacaaaatatttttaaattaaatgtggcatatgaaaacaacattaacttaatttttcctgaacctcaagctattgtttgatttggaaatgttatctctggtgtactttaaggatgtgtgaagcacacaaaaccataaggtgttatgaatgttattactcttgtttttttttttccgagtttgctttgtgagtctttttagatacctatgacaatactgtgtacagaagtccttgatgtgactttttcctcattaaatttctgaatcaatacatacatccactgcccgagatcatttgtttctccatcctctttgctgtaggtatttggaggatctgttgaatgctaagtttgtgatttaaggtaggggtgtgtgtgtgtgtgtttccttttttatgttttattttgtctttggggatgagagttttatttcttcctgtcacaacaattgggcaaaaaatagtagactaaactgctaagtaggtcgacctgcctgagcaccatgaggtggcaaattctaataagatttcctgacttcagcagttatcagtgatgggaacagggagtagaaatagcagtatttgaacttcaaatatccagggaagaataaatgagtttctgctttgttcaacatttgtaactaaagaaagattttacacctttttctatttcattttaatgaatattaccaaataaaggcatgaaaccagaattaaagaataagatcacagtaaattattatattaatggatttaggctgtgtagtaggcaccttctgtattctctaatacagtaaaagattagaaatagccttgcctccttgttgcatatgtgtataaaagtgaacgttaggcgttgaagctattaagggatactattttgtgtcagttattttggagatggatgttttgtaaaatcctcttagacattaaaatcaacaaatgctttgaatgaacttcagacctttggctttagcttagcttttggtcataggctggaatttcattttttgttgttgttgttggtctttggctactgacttgtttgcagaatggtgctcagctaaactcttccccatgtcattggtctaccaagtatcttaaaactctccagataacaatggcaagcgcattggacactgtaaagaaacacctcttaaggcgttaacacttctgaatgaattactccgattcctttaggttggtgcaaaagtaattgcgattttgccagcagaaagtgcaattacttttgcaccaatctcataattgacctgaaaccagttatgaggaggcaagtattatggaaaaatatttttcattcctgcaaggtcatgtggagagtgttttaaatagcaaagtcaagtacttattcaccagaatccagtttgatcacttgctgtctaattagtcttttgtgttaaatctttcagtttggttgagggacaacagggtagttttcgacaaatcatattaaaaccaagtagttttaacatttgagttccctacatctttattaccgttacctcagtttagtcctcattatctcttgtcagggttactactgtaatctcccactgatcactttctttagtctcttattaagtctgtactaatatctgaataatcatttaaaaatacaagtctggtcagataattttcttgcttccagtttcttcaaagctcccaatcgccttagaataaaaccaggctttcttagcatggaatgcaaggatcttagtgatctagtcatggcctgacttttcagtcctgtttccttacaacttcccccaaatgacttgtgggtccctgaaaactctgcagttttgcttttcacccttgcttttaatgtttctctgcttggcgtgttattgtattactgactagctcctatccatgctttaagacacaatttaaattttagaaacttttaattatggatattgtccaaacatacacagaagtagagagaataatataataaaccccatgcatccatcacccaactttagagtatcattttgcaaatttttcaaccatgatttttttttccaactcagtcttcactggagtcctccatgacctctctaagcaaagtgagccactcttttcctgtgttctctttagcaccttgaccatcctgctattagaatgcctgcaaatataattcctcatttacctgtctctccctctacaatgtgaatcctttagggtaggtaccaagctcttttcacctgttctctatgcctagcatagatgccaacacatcataggtgttaaatatatgtgaatgaaagtaataacctcttatcttcttcatccccacttgctgtcaccctttctttccttcacagaaatagcaaaaaaaaaaaaaaaacttgtttccccaaagaaaccagatacgacaaaagagtgtgttatgtatgcacatgtgcatttatttttactttttcaagaaaggcaaaactagtctatggtgatagaagtcaggatagcagtacctttggcagcaggtgagatggaggcattgttcactggggagagatcacgcatggaggagccttctaggttctagaaatgttctatgttgatctggatggtggttaaatatatgtgtgtataaaattgtatcaagtggtaaagttaagatatgtgtataatactttgctgtatataagttacagctcattttttaaatgtctgtttgttttttaaagcctgttctcttcaattattgttttttttttttttttttcactgctggtaacatcattttcttgattacccaaattgcaaaactgggagtttctccagacttctcccactccctcctctgaactctgatgaatccattttataaatagcatttgatctttcccttcttattcatccttagaacctctgcccccaggatatggaccagcctgtgatgggcccactttgtgtcaggtgtccccatggtcttatgtatttagggaggagtcatctggcttactacccacttaacaggagttgtgagtgggacatggctcaaaggccttgtttgggaaggcagtgattcacatcacttatatacagtatgtgagaatttaaggcatatccattaagccatttttagtacctagataagtgtatccgtgtaaatgaggttatggtatttgaagtaaaataacacaatttttgctaactgtatattttattgcagcacatctatgaaggtgtgccattcaatctcattggataaatgttaactaaagtttaaaagaaacaagtttttattacatgtagtgtggaaacgtgtagcacaatttaaggcaaggtgcattttacctaagtatcccttgtcattcttcttctattgaaggaaacgtggtaaaaataaaaagccataggaaggttccaaatggtgataagagtttatcctgtgagccttttccagttttatcagcagcagcagcagcattattattttaggcagagtctcgctctgtctcccaggctggagtgcagtggcaccatctcagctcactgcagcctccgcctcccaggttcaagagagtctcatgtctcagcctccaaagtagctggaataacaggtatgtgccaccacacccagctaatttttgtatttttagtagagctggggtttcgtcatgttggccaggctggtctccgtctcctgacctcaattgatccactcacctcagtctcccaaagtgctaggattacaggtgtgagccaccatgcctggccaccagttttattattaaagaaggacagaattgactcacttttaagcaagctgattttatgtttggttcttgagaataaatgtctcatcaaataatcagaacagatacaaggatgcaacgatcagaacagtgaatacttaaatgtgtgcagttccggagtagagtttattttcttatgtaatgacatttaagatcatattcttctgaaaataaactcagtatttaagagagttgcattgtggaaaatgcaactcaaagagttatgagctgggcacagtggctctcgcctgtaatcccagcactttaggaggctgaggctggagatagcttgagcccaggagttggaggctgcagtgagctatgaccacgccactgcactccagcctgggcaacagagcaagaccttgtctcttaaaaaaaaaaaaatgacagaatgccaggaattttagatacagaatgtaacatttgtttactttgtattcttcatatcattgttaaataacacatcttatagaaaaaaaaatataaaagctgaggattaaatttccatggtaacatcaccttattacactacagttgatccttcaggatgcaggggttaggggcaccaaccccttgcgcagctgaaaattcaggtataaattttgactcactgaaacgtaactaatagcctaccgttgactgccttaccagtaaaataatttttaacacatattttctatgttacatgtattacatactgtattcttatgataaattaagatagagaaaataatcataaggaagagaaaatacatttactttttattaagtggaagtggatcatcataaaggtcttcattgtcatcatcttcatattgaataggctgaggaggaggagtaagaggagggattggttttgctgtcttatgggtggcagaggcagaagaaaatctgcctatacatggacctgcacagttcaaacctgtgttgttgaagggtcacatgtaattagttttagattccatttaagtaagttttagtgctaaaattgttcagagcataaatatttgaaaattttatgttgattttatggaacctggcacattctttagaatcctgttacctccaaaacttatttgtaggctattatttgcataaaggacaatatttttctatgcatgcttcaattcttactgaattgattgcattgattagcgaaatacagattaaaaccccaatgagataccactatatatctattagaatggccaagattaaatgaactataatacaactgtttgcaaggatgcagaataaatggagctgtcatgctttgctgttggaaatgcaaaaggatacagccacttggcaaaaaatttagcaatattttgtaaagttaaacagtcacttaccatatgacccagcaataaaggctcttaggtatttattcaagagaaataagttactttcacacaaaaattggttcacaaatgcttacagcagttttattcattatcacgccaaactgggaaacaatccagttcatacgttccccagtgtttcaactgagttgtggcacacaactcatagaactgtatactaaaaagggtgagttttactgtatgtttatacctcaacttttattgaggtataacttatacttcaataaatctgacttaaattttttccgtatcttttaaggatgtaactgaaatatttacaggaaaaaaaagtgatacaatacctgggatttgcttcaaaattatctggcagtagagatagggataaaataagattgatcatgaataaattatagttacattatggggtgggtacatggatgttcattttatttttctctctactttcatacatgcttgaaataagcaacattaaaacaaattacaggttatctggcagatgtgaaatgggatctcatgttttaaaattttattttcctgtttataatgagttttagcatcttttcttattggcaatttgggtttcctcatttatgaatttttgtttttgtcctgtgcccatcttcctactagcttgtttggcttttacttattgattttagacctttatatattctgaataccagtcctttgccaattacacaggttgtaaatcttttttcccagtctgttattggcttttcaattagtttatgttagcttttgttgtatataagttttaaatttttatgtagatgaattatgaacctatttatttatgcttttatatcttagaaattctcccataggaattttttttttttttttttttttttttgagatgggagtcttgctctgtcacccaggctggagcgcagtggtgcaatcttggctcactgcaacctctgcctctcaggttcaagcgattctcctgcctcagtctcctgagtagctggtactacaggcacgcaccaccatgcccagctaatttttgtatttttagtagagacggggtttcaccatgttggccagatggtctcgatctcttaacctcgtgatcgccctcctcagcctcccaaagtgctgggattacaggcgtgagccactgcgcccggcctgaaatatttttatatttctttgtttttcacatttctctaacccttctggaatttatctttttgtataggaattcaatatttttttcatattgattaccagttgtccttatactaacctttcctactgatttggaatgcaacctacagttctttaccactgggctccctactgatgttggatcccttcctggaccatgttcttgtttggcaagaggaatcctagcccctccttcctgcccatatgatcagaagttgctttttctcctctgggtttctttaggagtagttatagatttatgctgctttggctttgcttctcttccaggtttggaaatgggtcattttaaactttttctcaggaatatacttggtggaggttggggtagagaggagcaggcaggctcaagctacagattttatatgttgaactggtttggaatgagtcttttaaattatttttgttacttattaaaaaaaattgactattcatgaattataagttgtataaaaaattttgtgggttttgttttaatgggttttgtttaaaaatatagatgttttattggattctattttaatttgggttaagaaaccctgaaccttgggttgcttaaatttctgcaataataaacttgcatcctcttctctagccaaactaaattacattctattccttgttcatgccatgttcctctagtcctctgtacctttgcatttgctgtcctcacaagtgacctttttttttccttatctgcttgggaaacatgtacatgtttctgtttatcttcttcactagtctgtgagctcttactatgtcttatttatcttttaatcccattaactgtgcacagcacctaaaatgtagtcagtgccctgtaaatgtttatgtgcaaccttagattcactatgtttgtgatgttcttcatgtataaaagttttaaaccttttctataatttagtttgacatttggtcagtgtaaatttaccagtttcacacatgtggattgttattggtcaggctctaccatgtgtactcaacctgttggcccctaatttgctaaatccaccaagattcttatgaaaacagttttttgtccaattggcccgtatgtagatttttctacgcatccctttggcacaagctagttaggatgcttttctgttctaccaatgccctttcccctgtgtagggccttttcttatccaacattcaactgcacttctccttccttttttttttgtttttgagatggagtcttgctctgtcgcccaggctggagagcagtggcgcgatctccgctcactgcaagctctgcctcctgggttcacgccattctcctgcctcagcctcctgagtagctgggactacaggcgcccgccaccatgcccggctaattttttgtatgttttagtagagacaggatttcaccgtgttagccaggatggtctcgatttcctgacctcgtgatccgcctgcctcggcctcccaaagtgctgggattacaggcgtgagccaccgcgcccggcctgcacttctccttcttaccctggttatagttggtagaacatttcctgattacaccctgattattgtagctattgtgatgtcatgctcttagtttgaaaggctctcttctttttattcctactaatggagcggttgaagagggcacgcctgcacgtgtggtctgcagagcacatcctttctgaactgacaggaatggagatgccccctgcttttttttcctttttgtaaacaaatgttttcatattgatttagccattttatacagaaagcttctataaaatgttattattacttatttatggaataggctccataaatgaaaggttaaaaaaagctttgttatttcttagaagataaaagctttactttttttgtatctgatcttttatcacatatattttctaataatggaagatagtgagaactgagaaataggttctgagttgtgacccttcaattttttaaaagctctgttatgttgtcttggttctgcttttaatgtcacttagtattgtctaaactgtactgaaatagcaagaggtggcattatacctaactcagctggttcactgtgctgttataattactaatacttatgaaatctaaaaattgaaagtttaaagagatgcctgcagtgctgataaaacgtggctgaagtgccactagaaatgaatgcaagtagaagtgctatatataataattcaggaattaggtcagaaattgttaactataaacaatgtaaatatgcttggtttgctgaggattatagtttaatgcagccatatatatgttcatcaacactaagtgcaatcatttgtagaaccattattacaactgtaaatcttttggggggataagtgtaaatgaatgagttttataagtctcatctctatactcaagaggcaaataactctatcaaacttacaggaccctttgaagattaagagcaatacaagtctgagagaaggtacttgtataaatttgtgtgctgacattctggccttagaaaggatttttaaatcaccaaagaaaagatcaacatatattaactacgtaaaagtagaaaactttggtatatcaaataaaatccatagccaactaaaaaaaattaaagtcttggagtgaaaaggccttgttaaataagatagaaatgctcagaatctgtaaaagaaaagattgataaagcttgctacataaaaaaattcaaaactttctgcatggaaaaaataccataaagttttaaaaaaagacaaatcaactcaagactaagtgttcatttcctgtgtatataaaggatatctacaattaataagataaattataacccaattaaaaatgggcaaaggatataaacagactgtccacagaagtggaaactatgtatatataacttaaataaaaatatatcacatatacatttttgcttgcacatgcatagggtacatctagaacaagattgtccaacatgtgggccaggatggctttgaaagcagcctaacacaaatttgcaaactttctcaaattatgagattttttttttaaagctcatcagctatcgttaatgttagtgtattttatgtgtggcccaagacaattcttcttccaaggtggcccagggaagccaaaagattggatacccctgatctggaggctttataagaatttggtaaaatttcagtggttatccctagggaggggacctaggtggctggaggacagaaatgagaagaggatttactttctaaaatattttttaccttttgattctgtacatatgtattaaatattaaatagacactatatatgggtacacatgtatgtgtacatgtacgtacacatatatagtgttttatgtgtatatatgtatttttaatgttaaaaacctagaaacaatctttagagcacagaatgacaaatttttgttttaacaaagagctcacacaaattaaaagcagcaacttataaataagtaagcaaatgaacaaacagttcacaaaaagaatgaataaacagacatacagaagtatgttcaatctcagtagcaatcagaatgaagcttggacataaccttctcagaaagccatttccaagtacctagggtcatgaatggcttttatgaatcctgtctgtataaacgaggtggatgctaaggtcaaggttagcgccatttttggtgcatccctacagcatcttgtatttgctgtgttgtggcacttaatcataatcagtggcttttgttggttggttgttcttcttgttttctgtcttcagctctaaactacaagctctctgaggtcagagattatgtcttctgttattttttccaagtctgccatcacatctggcgtctgtttgttgaatgaataaatgaatagagtaaatagatagtaatcaaaggcatagaaattaaagtaaaatattttggtttatttaataagggaaattaaattttaatatattgtgtgttgataaaaatgtaatgaagttagtatgttcatttactgctggtgacatagcacactgtttttctaaaatgttttcttcatctgccagtatatatatcaagactaccctctaccgcagcacagtttctttttttttttttcttttttaattttttttttaattatactttaagttttagggtatatgtgcacattgtgcaggttagttacatatgtatacatgtgccatgctggtgagctgcacccactaactcgtcatctagcattaggtatatctcccaatgctatccctcccccctccccccaccccacaacagtccccagagtgtgatattccccttcctgtgtccaggtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgtgccacatttccttaatccaatctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcccgtttctccacatcctctccagcacctgttgtttcctgactttttaatgattgccattctaactggtgtgagatggtatctcagagtggttttgatttgcgtttctctgatggccagtgatgatgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggttgccaaaattttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggaaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtcccatgctgttttggttactgtagccctgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtatcttgatggggatggcattgaatctgtaaattaccttgggcagtatggccattttcacaatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcacttatgatttagctctctgtttgtctgttgttggtgtataagaatgcttgtgatttttgcacactgattttgtatcctgagactttgctgaagttgcttatcagcttaaagagattttgggctgagacaatggggttttctagatatacaatcatgtcgtctgcaaacagggacaatttggcttcctcttttcctaattgaataccctttatttccttctcctgactaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttggtgaattttgtcaaaggctttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaagatattggtctaaaattctcttttttggttgtgtctctgcccggctttggtatcaggatgatgctggcttcataaaatgagttagggaggattccctctttttgtattgattggaatagtttcagaaggaatggtaccagttcctccttgtacctctggtagaattcggctgtgaatccatctggtcctggactctttttggttggtaaactattgataattgccacaatttcagctcctgttattggtctattcagagattcaacttcttcctggtttagtcttgggagagtgtatgtgtcgaggaatttatccatttcttgtagattttctagtttatttgcgtagaggtgtttgtagtattctctgatggtagtttgtatttctgtgggatcggtggtgatattccctttatcattttttattgtgtctatttgattcttctctctttttttctttattagtcttgctagtggtctatcaattttgttgatcctttcaaaaaaccagctcctggattcattgattttttgaatggttttttgtgtctctatttccttcagttctgctctgattttagttatttcttgctttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaactttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctatattgggtgcatatatatttaggatagttagctcttcttgttgaattgatctctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttgtaaggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttcctttatttcaactttggtgaatctgacaattatgtgccttggagttgctcttctcgaggagtatctttgtggcgttctctgtatttcctgaatctgaacgttggcctgccttgctagattggggaagttctcctggataatatcctacagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacatagttcttgagccttggttttcagctccatcagctcctttaagcacttctctgtattggttattctagttatacactcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctactttttgtctttgatgatggtgatgtacagatgggttttcggtgtggatgtcctttctgtttgttagttttccttctaacaaacaggaccctcagctgcaggtctgttggaataccctgccttgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtgaagcctacagtggcaggcaggcctccttgaactgtggtgggctccacccagttcgagcttcctggctgctttgtttacctaagcaagcctgggcaatggcgggcgcccctcccccagcctcgctgctgccttgcagtttgatctcagactgctgtgctagcaatcagcgagactccgtggggtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgccgcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccgccacagcacagtttctaacctttgacccaattctatttctccaaatctgtcttaagataatttaagatacaaaaaaaagtatacatttaaaaatgtctgtcacaatgttattcctaatagggataaagtggaagtattcataatgggcaacattaaagtaatggtttttacaaatcgttggttctatatgataggcattaaaaattataatcctaacaaaaaggtagcagtttgaaaaaaacgcttgtgctaaaataatgttaagacagcaaaattcagaatataagtatactttaataacaatgataaaatataaagaaagactagaagaaaatactttaaaaggagaaaacaggaaggtatatttatctgctgtaattggcataagtttaagtacagtggctaagactcctttctcaaaagtgctctaatgggcactactgcctttaacactctgattttttttttttttttttttgagacaaggtctcactctgttgccctgttgcccaggctggagtgcagtgatgccatcatggcttactgcagcctcaacctcctgtactcaagtgatcctcctgcctcaccttacagagtagctgagactataggcatgcaccacaatgcctggctaatgttttgtagagattgggtgtctctctgttgcccaggctagtctcaaactcctgcatcaagcaaccctcccaccttggcctcccaaagtgctgggattacaggcatgagccaccatgcctagccagatttctttttctttagatatatttaatacatccaaataacttattgtattatcttttatcttttggtaggagtctgggagatttctccaacagaacaatcatatgattatttttaaaataaaaatgtttacatattccagcaaacataatatccatattcttacgggttgctgcagttattgtattggtgatgttgcttacaaattttcaaggtattttggcagacaactcttgtgggcttttagggcctgaattgtgtctctgcccatattcatatgttgaagccctagcccacaaagtgatggtgtttggaagtgggggcctttgggaggtaattaggtttaggtgaagtcatgagagtggagcctgtgatgagattagtgcttttataagaacaggaagagagagaaatctctctcccttctcttggtgcatgcactgaagaaaggccatgtgtgagcacacagcaagaaggcagctgtctacaagccaggaagcaagccgtcaccagacactgaacctgccagtatcctgatctcagaactcccagcttccagaaatgtgagaaatgaaatatctgttgtttaagccaccctgtctctggtatttgttatggcagcttcaactgactaagatatgggctaacttttatgaatataggatgtgttgaaggcacatgatagctacttttatattttgcgcataatccattttactaacaaggaactgaacatgaaggccagtctctagctttttctttttttttttttggagacagagttttgctcttgtcacccaggctggagtgcaatggcacaatctcggctcactgcaacctccgcctcccaggttcaagtgattctcctgccacagccccccaatagctaggattacaagcacctgccaccaggcccagctaatttttgtatttttagtagagacagggtttcaccatgttagccaggctagtctcgaactcctgacctcaggtgatctgcccgcctcggcctcccaaagtgctggaattataagtgtgagccaccttgcctggcctctagcttttaactattaataaaattaaggttctgattgttagtgttctaagcatctgggggttttagaaagatactcgccaccagcctgaaaataacccaccaagaacttttatgatcttcaaaagtctagaacaagagaaacaaatttcacacagagttaaatggtaaaaatcaaagccaaggtatggaaagatctcccaaggagataagattgctcccaggctgagtcctgagaagtaaattgagataagtctgcagaaccttggaggttgtattgatgaatgcggtactccatgctatgaagtaagacagcattctgggccaagtcttactcaaagagaggtgctataaagctataaataatttttatactcttgttacccaggctgaagtgcaatgaagcagtctcggctccctgcaacctctgcctcctgggttcaagcaattctcccgcctcagcctcccgagtagctgagattacaggctcctgccaccatgccaggcctattttttatttttagtagagatggggttttaccatgttggccaggctggtcttgaactcctgatcggaggtgatctgctggccttggcctcccaaagtgctgggattacaggcatgagccactgtgtccagccatgtaaaggatttttatatgctccaaagttggagtattttgtaaaacactccatcgatttcattcatcccaaaatgtgtactggggaaggtgaggagggagttgagagaacctcactaggacacaggcttgttctgtgtccacagacccctgtcttaagaggtttcaggtcctagaatgtctttatgatttcttggctgtttatgatcttcaagtcttttatttagcaattaggtatgcaagtgtttatatacttcacccttcccacttctttgtaggtcatataaaagatttagtctttagcttgagagaaataggaagctattgaagaattctaagcaagggagtgacagagtcagttacgtttttacataaaaaaggtatctctcaaacaaagaaaaaaaatttttttaaaaggtatctctcacagtgttgtggagaagaggaagagtgggcaagaagatacatgaagcctacttaggaggctgttttagtaaataaagaagatgacagcttggactacaatggaatagatttatttaaaagatatttaagagcaaaaaccaatcggacttagtggtgttttagaagtgagggggggaaagagaagtgaaggaaaactttgaagtttctggtttatgcaactcaactgaaggtagcctcatttactgaagttagggactttagagacgagccaggcctggcagcaggcatgtgtgatgaccaccgccctggtgtcagacagtttgaattggaggtgtttttgagacactcaagcagggatgtcagttccacttgtcctcatttactatttaacaattagcccttctggttctttgaaggtcagagaaggctgtgctagagatatgatttgggactcacagatatttaaatagcaattgaaactgtggatctggtgaccatagcctgggggagggtaaaagaatgaacaagggaaagaggaggttgaagagaataagatcagagtaggcaaagaaggaactgccacatgtaggaggaaaactaggaaagggtgtgatcataaaagccaagacaaatgtttcacaaaggaagcagtggttaactatgttgaatattgccgatgctgataaaacatttagataaaaaaccaatttgttaattgctatgttaaatgaggagatgtggagtttttaaaatggcatagcaattagatagggaaatttggataatgagcagttaaagaaatgaattacgtttgctattatacttcttaagctgagtattaaactctttgtgttgcaaataacagaaacccaactcaggttcttttaaacaaagtaaataacttattccttcatggatttgaaatatccaggataggagtggcctccagcacaactgagtcaggggcttaaccaatattgttagctgtgtctctccctgtctctgcctctgcctctcagctccgttttcctctggaaggatctctctggtggttcctggccacatcaggcttttctgatccttacaataaataaccctaatggaaagagagctcctccttcctagttctagcaggagtcccaggatttacttaaattttactaatttaaatcacatcctttttcataacctaattactttggtcagaagtaattagatatgctgacaggccaggcctgaatcacctgctcacccctggaggtgggccaggtgaaaagtagccttgtctgaatcacatgggctctgaatagggggaggggtgatctcccaaaggaaaaccgaagaatgcatgctggggatacaaaaacaacagacagctattttagcggtaaaaagaagcctttggcccaatacatttgaataactgcttctgcaatatactttataggtaatcttttgacctaaaggatgaatggatgtatttgttgttataactttaaaagagctacagggtctgatttttaagactaaagaaaggttgtaattatttttgctgcatgtgctgctaccgtggggctgaatactaactaatcttaaagacacattgaggccaaaacaagcccatgaaaaatgttcagcatcagtaatcattagagaaatgcagatcaaaaccacaatgaattatcacctcacacccattaggatggctgctataaaacaacaaacaagcgaaacagaaagtaacaagtgttggtgctatggtctgaatgtttgtgtccccctaaaattcatatgttgaaacctaatcctcaatggaatagtattataagcattacatagtattaagcacccttaagaggtgattaggtcttgaggcctctgtcttcatgaatgggattaatgcccttataaaagagaccccagagagctagctagccccttccaccatgtaaggacacgatgagaaaatgtcatctttcaaccagagagcaagccctcatcagacactgaatctgccagcaccttgatcttggacttcccagccttcagaactgtgagcaataaatttccactgttcataaaccaccagtgtatgacacttttattatagcagctagaatggactaagacagttggcaaggatgtaaagaaactggaacccttatacactgttgatgggattgtgaaatggtgcaacctctctgaaaaacactatggcatttcctcaaataattaaaaatagaactactatctgattcagcaatcccacttctgcatctatatccaaaagaaggaaagcagggtctcaaagagatattcgtacactcatattcatcgcagattattcacagtaggcaaaaggtagaagcaactcaagtgtccatcagtgggtgaatgagtaaacaaaatgtggtatttacgtataatggaatattatttatccttacaaagcaaggctgtcctgtcatgctacatagatgagccttgaggacattacgctaagtgaaataagccagtctcaaaatgacaaatactgtatgattcctcttatatgagatgtctaaagtagcgaaactcatagaaacagagtagaacagtcatactaggggctgggggaaaggaaaaatggacagttgttatttgatgggtatagaatattagttttttttgcaagatgaaaaagttctggagatctgtcgtataacactgtgaatgcatatataatatcactgaactgtacagttaaatatggtaaagatagttttatatgtgtatcttaccacaatttaaaaaaattcatgacacattgactgattcaacaaattacataaatagatggtccttatggactaattgtatctcttttttttttcgttttgggttttttgtttgtttgtttgttttgagatgatccctgtagcccaggctggagtgcagtggcacagtcttggctcactgcaacctctgcctcccgggtttaagcaattctctgcctcagcctcctaagtagctgggattacaggcgtgtgccaccacacccggctaatttttgcatttttagcagagacggggtttcaccatgttggccaggctggtcttgaactcctgaccttgtgatccacccaccttggcccccaaagtgttgggattacaggtgtgagccactgtgcctggcctattgtatttcttaataaggattggtgcacgtatccaaaggcaaggggttttcaggggttgaatttgttagaagatgtacctagcaccccatcacgaacctccctgccccattttgccctggatatgcctctgaactatgtggttgttgtactttgcagtggtattaatagatttgtatgattaaccttatttttcctggttctcttttaaatagtccatttgtgttatcagtaactatcttttaaaagagtatttctaaatctttctaggagtttgcaactcattatatttgtttattagaaattaacccacactttcttttgccatagatgggattgctgttcttcattttttcattaattcatcaaacagacatgcctattgaatgtcattcttgagatacagaggtttgtgacatagactttgctctcaggaatctcacagacaaggcagatatgattcacaagacagggtaggaagtgctgtgacaaaggtgtgcacaagatgttacagggacatagaggatgagtatctctttcaggatgggccagagtataaagaaagtcttagcagaggtaatgactgggttaaactttattttagcattaaaaatacttaagaaacggacaaatccacaatcctggtgagagacttcaacacacccctctcaatagcaaatagaagagcagagaaaaatcagtaaagatgtagaagatgaaacaaaacaacaactgacatactgaacactgtacctagaatgacagaattcacattattttcaagtacacatagtatacataccaaaattgaataattgttggcctaagctatgcttgaggaaattctgtagttgtacaagcatattagaaaagatgtaagagtgaaaatcaaggatttaaacttctatctcagattgaaaaagaacagtaaatcaaacctaaggaaaatagaagaaataaagaagagaaataagtgaattagaaagcaaatgtataacaaaaaaaatcaagaaagcccaaaattggtactatggaaagattagtaaaattgatgaacccttacaaagactaatttcttgaaatagagaagatataatattaggaatgaaaagggggatatcactgtagagcctacaaacattaaaagaaggtatttttatcatctttatatcatgtatttgattggatgaaatgcacaaatttcttgaaaaatacaacttaccaaagctaacagaagaaagaatagaaaatctaagtagtaaaatgtatattaaggaaacttgtttctgttatttaaaacctttccacaaagaaaactgtaggcccatgtaacttgtctggtgaattccttcagatgtttaaggaagaactcagatttttctagataatagaaaaagggaatagttcctaactcaaattgaacacataaaatgaacagtacattacaatgaattgggtttctttaaagtatgctagggtagcttaatgtttaaaaatcaatgtgtttcaccacattgacaggaagtagaaaaagtagatgatcattttgatatgaatttttagcttagcagaaaaggcccttttcaaagaatctgcctgtcctccagcctcctctccttccctgtcatgtatacacacactccttcagccatatatggaatggtttgcacttctgaggcatggcatgttatttcttgcctctctgctttcacatgtatcatactacctgcttctttactcagtaacttacacttgtccttcaagtcagtttaggattcttggaagatgttgccagcatagtctttcctccccctttttccatctttattgagatataatttacatgcaacgaaaggcatctgggtaactaccaccaccacaatcaatatgtagaatatttgtattacccttaaaagggtgctccttctctataaatattccccacattgatctatctgctttccgttagtgtagattaaattcatattttgtgaggtttcatataatctgtattaactcttttgtgtctggcttttttcactcagtatgtttttgagattcacccatattgttgtttgtatctgtagttcattttctctaactgttgagttgtatatcactatatggatataccacaaattgtttatccaatacatattcatggacattagagtttcttctagtttttattaagaataaaacggttataaacattagtattcaagttttgtgtggacatattttcatttcccctaagtaagtacataagagttaaattgctcagtaatattgttggtatattcttaactatgtaagaaaccaccagactgttttccaaagtggttgtaccattgtacacaccaatcagcaatgcatgagtgttctgtttgcttcatatcctcagcaagacttgctattgtcagtctctttaattttagccattctgctgggtattggtggtatgtcatgattttaattgatgtttctctgatgaattatgttgagtatcttttaatgtgtttattggccattagtattatcttcctttgtgaagtgtctgttgaaatattttgcctattgagttgtctataagaggttatatatatatttatgtatatattctgaattcaagtccttcatcagatatgtgataaaagaaaaacttcagccgaattaaatttaaaggagtttaattgagcaatgaatgattcatgaatcaggcagcccctagaatcacagcagattcagagactccagcacagccacatgatggaagaagatttatagaccaaaaaaaaaaagggggaaatgaggtacagaaattggaagtgaggtacagaacagctggaatggttacagttcagcctgtgccttattggaacacagtttgaacacacagcagtgaatgaatggttgaagtctggccgctgggactggccaagacttagctattgttacaggtgcatactactaagttaggttttcagttttgtctgcctatgaagctaggttacagttcatccacaaggacacaaatgtagaagtatggagtccttctcaggccatatttagtttgctttaacgtatatatgttgtgaatactttttcttaatctgtggcttgctttttcattttcttaacgttgcctttggaagagctgatactttaaattttatgaagtctgatttatgaaatgtttcttttatggttcatactttttgtgtcctctgtttctaccccagggtggcaaagattctctcctatgttttattttagaaattttatagtttcagctagtacatttaggtctatgatttatttttagttaatctttgtgtatgatgtgaggtaagggtcaaggtccccttcttcccaactatggataatttgattgtcccagcaccattttttgaagagattgtacttccttcattgaattattgtggcacttttattgaaatcaattgaccttgtacaaggggtcttcaaaaagttcatagaaagtatattgtgaaaaatctatacaaggatttcattttttttgcaccaaaataaacatctactaacttgttataacatgtctgaacaggatctaatttgaggcactaagaaagaggagacatcagtttgaaaacaacccctattagagcaacatggattttgctaaaattgaagaaagaacaaacatcacatttatggtgaagcttggatggaagaagagtgaaatcaatgatgctttatgaaaagtttatgaggacagtgttcccaaagaaattggcagtttataaatggataaatcattttaagaaaggatgagacaatgttgaagataaagcccatagtggcagacaatccacatcagtttgcaaggagaaaatgaatcttgttcatgccctaattgaagaggatcaatgattaacagtacaaacaatagtcagcatcatagatatctcaattggttcagcttacacaattctgactgaaaaattaaagttgaacaaactttatgttgatgaataccaaaactcttgtgcccagatgaactgcagacaagaacggaggtttctttttatttttctttttttttggagacagagtctcactctgttgcccaggctggagtgcagtagtgtgatcttggctcactgcaactttcgcctcctggtttggagtaattcttgtgcctcagcctcctgagtagctgggactacaggcacccaccaccatgctaggctaatttttgtatttttgaatagaaatggggttttgccatgctggccagactggtcttgaactcctggcttcaattgatctgcctgcctcagcctcccaaagttctgggattacaggcatgagccactgtgcctggcccaaaagcagagctttcaatggaaatttttaacaagtgggatctagatcccaaagcatttcttcgaagaactgcaacagatgaaacatggctttaccagtatgatcctaaagacaaagcacaatcaaagcagtggctagaaagaggtggaagtggtccagtcagaggagatgtggatcagtcaagtgcaaaggtcatggcaatagttttttgggatgctcaaggcattttgcttgttgacttgctggagggccaaagtgcagggattacagacatgagccaagttgtactattcttactatctttttagtgcctgtgggatctgttgtgccatcttctcttttattcttgttgtgaatttgtgtcttctcactttttattcttgatcaatctagatagagattattattttttcaaagatctatatttttgtttcattaaattttctgttttctatttcatttacctaagctctatatttatttccttctacttatttctggtttagtttgttattttctgacttcatacagtggaagcttatattattattgctttttttctaagtatttaaaatcataagctttcctttgagtactattttcactatatatcccaatttttttctatgttgtattttcattttcattcagtttaaaatgttttattctgtgatttttttttacccatgggtaatttcacattgtgttatttaatttgtaaatatttggagattttccagttatctttatgtaatttttttctaatttaattcttttatgaccagaaagcctactctatagtatttcattcttcttttaaaaacctactctatattatttcagtctttatggaaggtatgcatatggtatatctttttgaatgttttgtgtgcatttgaaaataatgtatattctgctgctgatgataggtattctatgaatgtcagatcaagtaggttgattgtgttaagtgttccatattcctaatgttattcagtctacaagttctgtccattactgaaaaaggagttttgaggtttccaattctaattgtagatttatttctcctttcagttgtgtcagtttttgcttcatgtattttgaatagctgttattgggtacaagcacattcaggattgttacgttttcttgattaatttaaccctttatcataatgagatgttcctttttatctctggtaatgatccttgacctgacacatgtttgtctgagattgacatagccattccagttttcttattattagagtttaaatgctatatctttttatctctttttatctgtttctttacattcaaaatgaattttttctagatagaatatcgtctgatcttgcttttaaaatctattctgacaacctcttttcagggtttagaccctttgcatttaatgtgattttctgtgtaagtttaaatctgccatcttgttattttctgtttatcacatctatttttgtttgtttctttttccctcttttcgttacttttgggttaattcagtgtttttttaggattccatttcattttcacaattggtttattagctactcctcctttatcaccacccaccatggctgttgtagggtttacaatatacatctctaacttatcacagtctgtcttcaaatatatgctgcttcctgtgtaatgtatgaaacttaacaatagtgtacttccatttgtcccctggacaaatgtgctgctgttgtcatatagagcatattcatgaaatagcttcttcaatacccttttctgctaattttatcatctcttaaatttctgagtttgtttctgttgactcatttttctcaaggctactagtcattgttgctggtttttcatatatctagtactttttgatcagatgtcagatattgtgacttttacattgctgcatgctcacttttgttgtattcctttaaagagtacagaatttctttcaagcaagtagttaagttactaataatcagtttgacccttttgaagcttatttttaatctcttttaaggtagatctagagtagcttttactctaaggctgatttagcaatactcctgatgtattttttttttaaatagagatagggtctcattatgttgcccaggctagtcatgaacccttggcctcaagcaatcctcccatcttgggcttccaaagtactgggaccataggtgtaagctaccacatctggccctcatgtatgttttctactgaatgtcctgtgtattcaatgaagtctctctactctagctagttgtaacttaaacattcccagacctgtggaattctaggactgtttgacttacaattcctggtgattcttatttttccagaagttgttcttgctcagtcttatggtatttcgttctgcatatgtacagatagctattcagccagagattcaaggaacgcatatgcaggtttctaaagctcttcctctgtgttgtcttcctctcttaagtgccctgccctgaaaactgcagcatcttggcctacctgacctcccatctctttcttctcaactcactgggattgcaggctctgtttggatttccattctctgtgccaaagtctggaaattaattttaggaagaaagcctgggtgatggtagggctcactttgtctcccttttatcagatatcacagtcctgtactgtctattttctactgtctgaaaatagttgcttccaatagttttgtccagttttctagttgtttataataggagtataaattttgaccctcttattccctgttggtcagaaatgacatcacagcttttgtattttctcctatctccccataaaaatagacagttcaaacagggctgcaaaaccaaagacccatggataacatctacaactaaaactagatgactaggcattcctgtgaccttccaaatatgagtggatggagctacatcactgacagcttgaagacctgtgtgatgtcgttatctatacgggggggaaaaaaaggcatttcagcttctgataccttgagattgctaaggctatatcaaaaggacagggccaacttgaaaaggtcctcatagctaaagagaggcaatgtaaagatcagtaactgcaaaggatcgaaacagcaaatatatttaaatttgtaagtttcaaatgacacttttttaaaaaaaaaccctcattgtaatctttggaggatactagagaaccacctcattattttgaaagctgacaaatacaagaaatgagggtgagcatttatcccacctttcctatttttacctagtataacaaaatagttgatgaggcaaaattcctctttcgagatgtattctgtctcataaagaatgaatgaaaaaatttaaaaattaccattttgcaaccccagatgaattaatgagtgtaggcagtgattatcaatggctgctaatatcacaaaaagaataaaaaaccattatgtacctactatggaatcgaatacctgtcacttaggaagtaatcttataaaatctgagaaaaaaaaatccaacctgaatctgcaagcttcttgatctaccgctttttgagaattataagacagagttacatattaaaacacaccatggagatacaaaaacaaaatttagtgaggggactttagggcaggggttagcacacaatgcgtgggacacatctggcccattgcctgtttttgtatggcttttgagccaagaatagtttttacattattaaatggttgaaaaaattcagaatattttgtgaattatgaaaattgcagcgttcataaaaaggttttgttggaacacagccatgcttatttgtttatgtattgtttgtggctgctttcgtgctacaagggcagagttgagtaggtgcaggagtctgtacaatcaaaatgccaaaatatttactcactggcccttaacaacaaaaaaaattgtcaatccctaatctagaggactaatggcctggtttctttaacaaaaaaattccaagaaaaaggatgaaaggaaaaatcagtaagacttaagagacatgacaagtatcacaatatgtggaccttatttggatccctattcaaaacaccatgtttaaaaaaccaagatcatcaggaaaatgtgaacagcaacaaagatacttgatgatattacggaattgttaatttttaaaggtgtgataatgattttgtgattatattttaagaggtccttagctttttatttttattatttatttatttattttatttttttttttggagacagagtctcgctctgtcgcccaggctagagtgcagtggcgtgttctcagctcactgcaagctctgcctgccaggttcacgccatcctcctgcctcagcctcctgagtagctgggactacaggcgcccgccaccatgcccaactaattttttgtattttttagtaaagacggggtttcaccatgaaagccaggatggtcttgatctcctgacctcgtggtccacctgcctcggcctcccaaagtgctgggattacaggtgtgagccactgcgcctggctggtccttggctttttagagatagattctgaaatatatacagatacttggatttgcttcagaataatccagggagatgggagttgttgagtgtggatgtaagtaaaataagattggccatgttatgaaaattgtgactggaagatgggtgcgtagtgtgatggctcatcacactgttttactattttctctagctttgaatgtttgaaaacttagagtttaaaataaatcagttatttcaaaataagtttaaaaaatcagttcaaaggccatttcctctggacctagtaattgaatgcctcttttctgtgcttctgtagaatcatggaacttaccacattgattattgttgggtggttatttgtttaacttcccctagactcccagctccttgagggcagggaccatttgactttgatctgtagtgtcagttataggacatagcacgtaatctggtacatacttctggaacaaatataataacttttcatggcatatcatgatttctagatgataaaaattgtaaaacacagtcgtccttttttgttgacattatttatttttatttactttactccttccaaatagcctatagttcagcatgaaaccaaactggttatatagcttttataaatcaggaaaaatataactccaaaataaagtaagttatagaatgggcatcttagtttgagctatctcagtctgagatatgatattaagtgtggaataggtactttgaagtaaggcaggtattgcttctccaagcacaatattgtatgtttctgaatattgcagaaatatccatattcaaatctaagaccaaaatctaatcaaaccagctacaaattatttctatctatcttattattcccttttgttagcttaataccttaattattagcttaacctaacaactggttatgattattgaaaatttaatttttgcctgggtgtggtggcttatgcctataatcccatcactttgggaggcccaggctggaagattgcttgcgaccagcccgtacaacatagcgagaccccatctctacaaaaaaatttaaaattagctgggcatggtggtgcatgcctatggtcccagctattcaggaggctgaggtgggaggactgcttgagcccaggagatcaaggctgcagtgagttatcatcgtaccactgcactccatccttggcaacagagcaaaactctgtctccagaaaaaagaaaatgtaattttagaaatcccaatcttttgctttgttttccctcttcacatcgttgtcttcatatttgtagcaattctcttatcatggatttttttttttctgttttcagtgaaatttgatcctcacaaactgagctccaggatagtgagtcagaaacacaaccctgaagcttaagccagggtctaatttttaaataaatcacctggcaccaaaacaccttctcacattcatcaagaagcgcttttggtgttctgggcctggggacgaggtgcactgtgaaatgatcagtcatccagttacttttgtaacctgattctcctatgctgttttcctctgaatcagggttttaacagcaggtgtgaacatttagaattgtcattttcataaaaataaaatgctgttttcttcaaagcatttacaaaatcataatgggaagattttaaagctaatttacctagctaaatgccagtgacaccccatgatattctcctggcttccttgcccaaactggtaggtgaagtcagaactgaggggtgtctgaggtactaatggaactagctcaatggcagagtcaacagcaagggaaacagactcagtagggttaagggcacaggtagtttttcccaccatctttggacttcagattgtgtacatcttatctgtgcatccattttcttaggtacttttctccctttcgttgatggcttcctttttatctctatggcaagtcttcattatgtatgatagcaggggccacggagtgcatggatgaccacaatttagaaacgcacttcataatttataatgcatgaaaagcaaagcttgagattctctttatatgaagtgtagtgtggcgccccatcttggtggcattctggccactgcccctcaggctgtgccagaactgggcaaattaagggatgggtcaaagtgtgttaggaggaaatgggggtgtcaaccatgtgccagaaattggccctctttcattcaacagacatgctgggcacaaagatgaatgtaccccagttcttgatctcatgaagtttgcagtgaggtgtaggggctacaaaaagaagacagggtagaagcaacagccagccattgcagggcacagcacctcctgctgctagactccatgcagatttgacagcccttatttctactccatccctgtgcatcacctgacaccattgacaagtttctctgctggaaactctcacccctcttagcttccacattactctgtcctggacattaattcttggtattggctcttgttcttttgtctgatggtaaattagcatttcctagagttctccactcttttttttttttttttaatactttaagttttagggtacatgtgcacattgtgcaggttagttacatatgtatacatgtgccatgctggtgagctgcacccactaactcgtcatctagcattaggtatatctcccgatgctatccctcccccctcgccccaccccacaacagtccccagagtgtgatattccccttcctgtgtccatgtgatcttattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccaatctatcattgttggacatttgggttggttccaagtctttgctattgtgaatagtgccacagtaaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcactagcaaggcaggccaacgttcagattcaggaaatacagagaatgccacaaagatactcctcgagaagagcaactccaaggcacataattgtcagattcaccaaagttgaaataaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaattaaatactttacagacaagcaaatgctgagagattttgtcaccaccaggcctgccttacaagagctcctgaaggaagcactaaacatggaaaggaacaaccggtaccagctgctgcaaaatcatgccaaaatgtaaagaccattgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacacaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagagatcaattcaacaagaagagctaactatcctaaatatatatgcacccaatacaggagcacccagattgataaagcaagtcctgagtgacctacaaagagacttagactcccacacattaataatgggagactttaacaccccaatgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattacaaaattgaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagatacaaaaaacccttcaaaaaattaatccaggagctggttttttgaaaggatcaacaaaattgatagaccgctagcaagactaataaaaaaagagagaagaatcaaatagacacaataaaaaatgataaaggggatatcaccactgatcccacagaaatacaaactaccatcagggaatactacaatcacctctacgcaaataaactagaaaatctacaagaaatggataaattcctcgacacatacactctcccaagactaaaccaggaagaagttgaatctctgaatagaccagtaacaggagctgaaattgtggcaataatcaatagcttaccaaccaaaaagagtccaggaccagatggattcacagccgaattctaccagaggtacaaggaggaactggtaccattccttctgaaactattccaatcaatacaaaaagagggaatcctccctaactcattttatgaagccagcatcattctgataccaaagccaggcagagacacaacaaaaaagagaattttagaccaatatctttgatgaacattgatgcagaaatcctcaataaaatactggcaaaacgaatccagcagcacatcaaaaagcttatccaccatgatcaagtgggcttcatccctgggatgcaaggctggttcaatatacgcaaatcaataaatgtaatccagcacataaacagagccaaagacaaaaaccacatgattatctcaatagatgcagaaaaagcctttgacaaaattcaccaacccttcatgctaaaaactctcaataaattaggtattgatgggacgtatttcaaaatgataagagctatctatgacaaacccacagccaatatcatactgaatgggcaaaaactggaagcattccctttgaaaactggcacaagacagggatgccctctctcaccactcctattcaacatagtgttggaagttctggccagggcaattagtcaggagaaggaaataaagggtattcaattaggaaaagaggaagccaaattgtccctgtttgcagacgacgtgattgtatatctagaaaaccccattgtctcagcccaaaatctctttaagctgataagcaacttcagcaaagtctcaggatacaaaatcagtgtgcaaaaatcacatgcattcttatacaccagcaacagacaaacagccaaatcatgagtgaactccattcacaattgcttcaaagagaataaaatacctaggaatccaacttacaagggatgtgaaggacctcttcaaggagaagtacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatgggactggtaccaaaacagagatatagatcaatggaacagaacagagccctcagagataacaccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctggaagaaaacctaggcattaccattcaggacataggcatgggcaaggacttcatgtctaaaacaccaaaagcaatggcaacaaaagacaaaattgacaaatgggatctaattaaactaaagagttctccactctttcctgtcccacccagtactatcaattctgaacctcaatttttctgcctcagcactttcctgggttatgacagactctcatcaattaacagtaacttcctttggcagtgattcttgacctggtgggggaacagtatccaaagctccagtagcagaagctcccttggtgattttgacacatttccccctcctcttggacagattctgtgtcttatattttaacccctagcacagtggccagctgtggtaggagctcagtgatgttaaccgcatgtttaatggcagtaagcacagcatgctatgagaacacagagcaggtcacttaattgtgagaaagtcaggaaaagctacagagaagctatcagttgagccaaactgaattctctagatggataagccttaaaagagattcaaacaggtggattttcacagcaaggcagatcagttattgaaatttatgtatggcaagtggttagacacacaggcttctttactaaatctcagcattaggaggaaagaactctttctgaattttgaacattagcataagtcaaataaaagtaagatgttctatatcattggataggtaatagatttgtggtcatcactgctcccaagaaatgatactggtcctggcatgaaatagtctaattaatttttaaaaataatttcaattttcattttagattcaggggtacatgtgcaggtttgttacctgaatatattgtgtgatgctgaggtttgggatacaaatgatcccatcacccaggtagtgagcatagtacccaatagatagtcttttaattaattgtaataaagtgtttcatttattcactcaataaacttattgaagcaccttctagtgttaagcactataataggtgctatatattcattagcgagcaaaacgaacttagccccttccctcttggggcttatagtctagtgaaaaaatagacattaaggaaatcactacaaacacacagacacaatgataaatgctatgagagaaagtggaatgttgagggaaagtacaacagagtcacctagttgagagactaggcaagaagtgaacaatgatcagaggttaattaggcaaaaaaattagggggaagaggcagaagagatataggaaactccatggcaaaatggtttgaacaaatcgatgaagagccataaagcagctcaactaagagttgctgttgaggaggaagggcacaccccttctcaggtcctgcttctgcctcttccttgagttcatgccatattgtagtgggtatccccccctgaatcaactccagcgacagtggtctccttgcaggttcccagacaggctatgctgtttcatgcctttttaaaattgtggtaaaaaacatgcgacatgaaatttaccctcattttaagtgatcagtacagtattgttaactataagcacagtgttgtccacaaatttaagcattatgcataagcattaagcataacattaaacaataatgttgtccagcacaaatgtttgcacaaattttctcatacatgcataagaagcttacacagctcaaaaatcagagcaatgtaaaaaggcatagagaaagcttttattcccacccctgccacatctgcactgttcgccttcactccctgcagataatatttttattagcctcttgtgtattagtcctctagttctttatgtaaagaatatacattgttatgttctctcttattaaaaaagtagcatatgatggacattgttatgtagcttgcttttttgcctaacaatacgtgttagagttcagtttatatagagctgcactgtccaagatcagtaggagtcatatgtggctgtggagcacttgaaatgtggcaggtgcaactaaaaatggaattttaaatttaatttaatttaaatttagatttaaaaaatgaaagcagtgaacaatattttcctattaatctcaactttattgttttagtaggactacatttcactttaactattgaaaatccaacatccaaattgagatgtggtataagtgtaaaacacacactggatttcaaagacagtataaaaaaaatgcaaactgtctcattaatgttttacatcatttacaatctagtcatcaatttgttcagtgttttttgatatagttggctaaataaaatattaaaaccaattctgccaatttatctttttttaaaagtgatactagagaactttaaattacatatgtggctcaaattctatttctttttttttttttttttttgagacagaggcttgctctttcgcccaggccagactgcagtggcgctatcttggctcactgcaagctttgcctcccgggttcacgcctttctcctacctcagcctcctgagtagctgggactacaggcacccgccaccgcacccagctaattttttgtatttttactagagacagggtttctctgtgttagccaagatggtctcgatctctgacctcgtgatccgcctgcctcggcctcccaaagtgctggaattacaggcgtgagccaccgcacctggctcaaattctatttctactggacagtgctgatacataacatttactactttttacacctgtatagtattccattgtatagagtaccacaatttacttaaccaatccacctttgatgcatacctgagttgtttccaatcttatgtttaaaaaaaaaaaaaagcagaaatgcttacccttctccatgcatcacttcatacatgggcaggttgatctgtaaaatgaattcccggcattgggattgctgggtccaaatgtaaatacatttgtaattttgatattgccaaattgccctccgtaagcattgtaccaatttgcactcccaccagcaatgtgtgtgagtgccagtttcctcatacattgccacttgaaactacaattaactgtatttttggatgtaataatcaacatttctttttgctaattctgagagggttttaagaagaaatcataaatggtttgtctaacttctctttccatttggaaaaaaaacctattgataaaatgcttagaggtagcatttcagaactgattttttttttttttttttttttttttgagacggaatctcactctgtcccccagactggagtgcagtggcgcaatctcggctcactgcaacctccgcctcctgggttcatgccattctcctgcgtcagcctctggagtagctaggactacaggcacctgccaccacgcccggctacttttttttttttttttttttttttaaggaaagcatcaaagaattaaccctcactgtttcccaggttgtaaatttctatgaaagttgcaactttcaccatactgagatttaggcagagggattttgtgagggttcaaatggataagggactacattttcttctgtttttttaagagttggggatttctcagattactccagcagccttccctggctgtggtggactaacatttaagggtagactggcagtttccatgcaatttttgcatattgtcagttaatctcctggattggttttactgtatgctaaacatattctaactcaatgggttgcttaactgaggaaaccagtgacaacataactggcgcttaagagctgccataatcatcagatagttcattccactgactttattagtaaatggcagagaaagtttatcttttcactttatggatccaactgttgtccctcatttgagacttgtgtgccctctactgccctctttgcctttttttgttttttcagatggaaatgaagaagtaaacattcagtatccaaaagaaaactgctttaaattttccattcataggaatatgaaaataagattcttatgaagagaattcttactatggagttagagacgtgccagataagttaataaatcagtataatggaacccttgatttgggggaatataaaatattttggcaaatcctagaggcatagaaaggcattttatatcaaatatgactatggacacttaactatctttagtattgtattgattttcaacataaaaagattaagaaaaaaaagttgtcttacgttcctcatgcaggaaaagcaccaggacattgaggacttagtataagggtcatccttggcaactggttttattgagtcattgctactatgtttgagttacacaataaacaaatatacaactttctaacaggaagtagctgcagccatagctattcttcatatttttgtttctgttgctaatttttgcctaattttgtttcaggaagggttttcactcattggtagcaaggactggttgaagattgtaagacgcgtggattgtctgttgtttggaacaacgataaaggcaagatttaagctaatgatcacactcttctcatcttctatgtgtgtatgttggggaggtatttgggggcatctcttggtaggtgacgggtactgggaagaatacaaatgtttaagaaaggtttgtactatgagaaaaacatgaaacaaggaccgtagagaggcagaagcctcattagcaggaggacattgctaaggagtcaggctctgatggatttctcagtatgcgtctgatggagctgtgcagccattctctatcccccaagcacaaattggaagtggagtacatcatttgtcttgcgatttggatgtttaaaaaggtgtataccttcaaatgattcagtgaatatgtattttcattttttctttttaatattaaaaaatttcccttttacttgctttctagctgtattaagtgtaaagaatgatcttcatcaaagaaacagtcatattaatcacctggatcattttccttcaaaaataactatgaaaaccaatctgttaacattcatggagtagataatattgaaatttaagtgaaagatactaatttttgagggactcagactctgagagttagacgattatctagtggaggggtattaacctggggtacacagaccccagagtctccatagaattcagggggtccatgaacttccatggattttcactgacctctaattgaaatgtatcatttccttccactatgaatgtaaggccagcagaccacagtagttttagaccttctcactaatggaaatcacagatactttcatatcacatttcagttgtttctgacatctcaaatgtttatgctcatcactacctcaaaattaaggtgtttattagtcctcctactagatctttattatcaaatacattaataaagaagcatatatattagttcacaaattagtgccttaatattgtaataaactaattcagtataattggtttctttgtaaacttgtgcattttgtgtgattaaaaacattgttctgagaaggggtccactggcttaccagattgccacagggatctggagcacacactccaaaatgttcaagaacccctgttttgtttcccatataaggaaattgacttaagccaatagcccaggttatgactagctatcagagaaccaggctgccctttgatctttggacttagctccagaccatatcatactgaatgaatgtatagatctctgaaaaagttatacatgctgtatgtttgatacttgagttttaaatttttctaaatatacattattactaaaattttaaactaactacaaagagcaaaataaaaatcaaccataatttgaccactcaaaaataattattaatattctgaaggttttactaagcatatatactatatcagttaggattgtgttcagatgcatgtaagagaaaaatcagctataatggcctaaaaaaccagatttctttttttttcacttaaaaggaaatctaggctgggcatggtggctcatgcctgtaatcccagcattttaggaggccaagacaggtggatcacctgaaatcaggagttcaagaccagcctggacaacgtgatgaaaccccatcttttttaaaaatacaaaaattagccaggggtggtggtagatgcctgtaatcccagctacttgggaagctgaggcaagataattgcttgaacctaggaggcagaggttgcagtgagccaagatcgcaccactacactccagcatgggcaacagagcaagactctgtctcaaaaaaaaaaaaagaaaaaaaaaaagaaaaaagaaatctagagacaggcccttgctagcatcctccagcaactcaacagtgtccaggttggcatctcggtaattctcctggcctctccctcttgggtgcagaatggttgctgcagctctactatatttccattgaaggaaggtcagcatcacctggcccttttataaggaaagcatccactttcctatatagctctccaccacccacaacccccagaagatgcctgcttatgtgtcatggaccagtgtaatatggctgtcccaaactgcaaagattaggaaaatgagcgtttgacatttccagcccctcttgtggattggcttgtgctaattgagtgtccaccatatagataatttataaaatggggattgtagtactttgtatcctgttctttttatcaggaacattataccaagtcattagatagtctctgaaagaaaacactcataatggcttggtagcgtgttattgtttggatgcactagggtttaactcatcgctaatttttcactattataaaaatgttctgattttcataaggatttatttacagggttcttgagatagaagtcctagaagtatacacttttttttttttttttatataaatttgccctcccgataggttgtccctgcttctactctactggcaatgtgtaagaatgttcatttatccaaatcctctccaacgtggtgatacaatttaaattcaaaaactagtttctaatttgacaggcagaaataagcatattcctttaatttgcatttcttgttaaaactgatgagaatggtaatgtaacatttgtatttcttctgttaatcacctgcttcttttgcctagtttttctcttcttcaaactacgtataatttgtgtagctatataattttatatatttgtgtatatactgtatgcacagactttttaaacatttaaaactaggaaccatttgcctgttattgtcaatggtttttttgtttgtttgtttttgagacggagtttcactcttgttgcccaggctggagtgcaatggcgtgatctcagctcactgcaacctcctcccgtgttcaagcgattctcctgcctcagcctcctgagtagctgggattacaggcatgcgctaccacacccagctaattttgtatttttaggagagacggggtttctccatgttggtcaggctggtctcaaactcccgacctcaggtgatctgcccgcctcggcctcccaaagtgctgggattacaggtgtgagccatcacacctagctgtaaatggtattctttatcccaaatatattttcagccagttattattggatttttttctgaattagtttaaatttaacctccttactaaacttttattaactgttttttaatttctaggaaagtgtttttataatttacagacaattgtatttctttccaatgatttatattttttattactttccccaccttaccgaattgtctagatctcccagaatgctgtaatcatagggttatagtatctttgacgtcttcctgacttgcatgggaagtagtgtttagacattaactccatctctgtctgttaactggcttttttttttttttttttttttttgagaagagtctaactctgtcccccaggctggagcagtgttgtgatctctgctcactgcagcctcaaccttcagggctcaaacaatccttccgccccatccttctgagtagttaggaccacaggagtgtgccaccatgcctagccaatggttcgatattctttatcatgtaaggcagattctctttcaattatagtttatttaatacctttatcaggattacatatcattttatcaaatgctttttgacaagtattaagatcatgggtttcttcctcctttgatctattgacttgatgtaatatgttgacattgaaccaacagattcttcttttgccctacctggcaaagagtatctgatgcatcttggcttggataacttttagttttcaagtattatgccaaaacactattatttaattgacaaatggaagaagtaaaattttcattccttttatagcaatttaatataaattctatgagtagtaaacattatatttcttttctctctgaactgaaataagtaggttgaataaattctgcctacttataaggtaggcttccctttttccagcaattctgatcaaatagggggctaacaatagacatataattccttatcttaagggcactttggctcaaagaaggaaacccaaacaaccactgtcctctttacttctcactcccagtaactcacggaggagtttttaaaatgatttcgtctagccaaggctttgagtattgccttttagtttcaaagcaaagaatcaaataaaatgctgaagtaccttctctgtttaagacctttttctgtacttccacattttctatagtagaggaattcacaattagcggtggggaaaactgcttcagttggggtcttagtggtaatggaaaatttcttaccaacctgggtgatgaatctaaaaccagcgggaaaacccactgggtttttatgaggcctctagtgtctccttggctctctatgtcatgttaactgggctccacattttccagggcatgacgatgccttggaacacctactgtggagcctgtggcctaagcatctctgtatggagatgctattcatacctgtgagccagcacttagtaggcctaatccctttgtgagtacacgtagataagtgaaaagagatgagcacttatccttaaatttgcttccttgagtctgtattagttgttataacttgaaattaagtgttctgaaggagggcaggtgcaactttacatgtaagccaccacttcagatacagtaattatgagcccatcttcttaggtgatagaaactagagactgtatatttggcgaagttcgtgattgttggtatacttgagaacttttcacttcacagcaagaagctctttctgacttttaattatggcataaaaataaatctcatcaagactttcaatctttagcagtccctctggttaacccagtggaaagttttccattatggtaacctatggcattgaggatataggatggagatacaactaattttcagatttttcctgatgtacctgggttttatcttggatccacatgcattgaagtggtatttctggctttagatgataagctcaaattctaaaatttttacagaagcaaacatggaacaagacttcagttaggctattagacatgtaaactactctgttgcttttttggaattatactccaaaaaaaaccctagctatccaaactgattattatatacattcacatatagatacctgtagacttatataactggtctcaggtttttgccctgcttgtatgcttagtgtctgcttgtgcatacagctttttaaagctagctatgaaatacagttgctgatgtcactgtcagaaagttaattgcagaatcctaatagctaatataagggtacttcatatagatgtcttcatatagagtctgttggaaacagctaaataactgtaaacaagaaatcagtttaatttcacaaaagaagattcatagtagtattatagattgaatgtataggtctcttatcagttcttttcccttcctcagggaaggtaggctttcaatgactcctgataatctggggattatccatccaagaggaaaatggctaagggcatgaataggtaatacactaaaagaaaaaatacaaatgaccaataagcataagaaagatagtcaacctcacttgtaatcaaagaaatgaaatttttaaaaaactatgttaacctagtatgttgacaaaaatttaaaaaaagaatcttcagtgtcggagggaaatgggcacatagattcttggtgggagtaaataagccctgtcttgccacaggggagttaggcattatgtaccaaaatatgaattacacacatcctttgacccagcaaatctgcttttaggcatgtatacacaaagatgtatgtataagagtgcttgttaaagctttgtggtttataataggaacaaaggctggaaataacctaaatgttcatccatagggggccagttaaataaaggaatactcttcagccattgaaagtaatgaggtatacttctatttttatatatttgatgttaaattaaaaattatgttatagaacagcaatgtattttacatatacacacacaatatatataacctataaaaatatatttatcagtgaactcatttttgataaaggttacaagaacataccctgagggaagagacagtctcttcaataaagagttctgggaaattgctgaggcaggagaatcgcttgaacccgggaagtggaggttgcggtgagccgagattgtgtcattgcactccagcctgggcaacaagagcaaaactctgtctcaggaaaaaaaaaaaaaaaaagagttctgggaaactgatatctatgtgcagaaggatgaaacaagactcctatctttcaccatatacaaaaatcaaataaaaatggattaaatacttaaatcgaagacctcaaactatgaaaactactacaagaaaacactgaggaaactctccaggatgttgatctgggcaaaaatttcttcagtaataccccacaagtgtagacaaccaaagcaaaaatggacaaaggggatcactttaagttaaaaagcttctgcacagcaaagtgaagagacaacccacagaaggggagaaaatatttgcaaactacccatataacaagggattagtaaccagaatgtataaggagctcagacaactcaatagggaaaaaaaatctaataatctgattaaaaaatgggcaaaagatttgaatagacatttctcaaaaagcaaatggtaaacaggtatatgaaaaggtgatcaacatcactgatcatcagagaaatgcaaatcacaactacaatgagataccatctcactccagttaaaatggcttttatccaaaagccaggcaataacaaatgcaggagaggatgtggtgaaaaggggaccctgttaaatggttggtgggaatgtaaactagtacaaccattatggagaacagtttggacgttcctcaaaaaactaaaaatagagctaccatatgatccagcaatactactgctggatatgtacccaaaagaaaggaaatcaatgtatcaggatatctgcacccccatgtttgttgcagcactattcactatagccaagatatggaagcaacctaagtgttcatcagcagataaatggacaaagaaaatgtggtacttatacacaatggagtactattcagccataaaatagccatacacagaatgggtataactggctagccatacacagaaatacaaaaattaattcaagatggattagagacttaaatgtaaaaccaaacgctataaaaatgctggaagacaacctaggcagtaccatccaggacacaggcacaggcaaagatttcgtgacaaagatgccaaaagcaattgcaacaaaagcaaaataggatctaattaaaccaaagagccatgcacagcaaaagaaactatcaacaaagtaaacacaaaacctatagaataggagaacatttttgcaaactatgcatatgacaaaggtctaatatccagcacctacaaggaacttaaatttacaagaaaaaaacaactccataagaaagtgggaaaaggacatgaatagacactttttttttcttttttgagatggagtcttgctgttgccaggctggagtgcagtggtgtgctctaggctcactgcaacctccacctcccgggttcaagtgattgttctgcctccgcctcccgaatagctgggactacaggcatgcgccaccatgcccagctaattattgtatttttactagagacagagtttcaccatgttggccaggatggcctcgatctcttgaccttgtgatcctcctgccttggccacccaaagagctgggattataggcatgagtcactgtgcccggcctgaatagacactttttaaaagtaagacatacatgcagccaacaactatatgaaaaaaagctcagtattactgatcattagagacatgaaaatcaaaaccagtgagataccatctcataccagtcagaatgactattactaaaaagtaaaaaaataacagatgctggcgagttgtacttatatactgttggtgggagtgtaaattaggtcagccattgtggaagacagtgtggcaattcctcaaagacctaaaacaccatctgacccagcaatcccgttacttggtatataatcaaaggaatataaatccttctgtaatattcacacatgcatgttctttgtggcactattcacaatagcaaagacatggaatcaacctaagtgcccatcaatgatagactagaaaaagaaaatatggtacatgcacaccatggagtactatgcagccataaaaacatgaaatattttttgtagagatggatggagctggaggccattatccctagcaaactaacacaggaacagaaaaccaaataccacaagttctcacttataagtgggagctaaatgatgagaacacatgaatacatagaggggaacaacacacactggggccttttggaggtagaggaaggagaggatcaggaaaaataacgaatgggtactaggcttaatacctgggtgacgcaataatctgtacaacaaactcccatgacacaagtttacctatgtaaaaaacctgcacttggacccttgaacttagaataaaagttaaaaaaaaaaattatgagatcttgttacttacaacaacatggatggaactgggggtcattacgttaagtgaaataaaccaggcacagaaagacaaacatcacatattctcacttatttgtgggatctaaaaatcaaaacaattgaactcgtggagataaagagtagaaggatggttgccagaggctgggaagggtagtggggatggttaatgggtccaaaaaaagaaagaatgaacaggacctagtatttgatagcacaacaggatgacgataatggaaatttttaaatacacgagtatggttggattgtttgtaacacaaaggataagtgcttgaggggatggataccccattttccatgatgtgattattactcattgaatgcctgtatcaaaacatctcatgtacctcataaatatatacacacctatgtacctaaaattttagaaattaaatatacatgagtgtttgtatatattcttttatacacccacagatatatatgactcttcatattttttccaatgttggataagataatgataatggatgacttttatattcagggggaaaaattaaatgaattaaaatataaagagtaccaaatactggcagtgaaaaggggcagtggtgcctattcttctaaacatgatagcttaccattatctcagccatgccaagagttttctgtaatctaaatatatggctttacttgatgggtttatttaaatagtgtaaattatgaacaggaaaatcaaggactatttatttgcttataggaacttacaggattttgttaactgtagttaggagtgttttcaaggaagcaacatggtatatatatttcatgagggaaaaggactgtcactgtgctaagcttagcatctacatttctttacagaagaaactgatgaaaggtatacaatatatacagtcctgtttcgggaggcttttatgtaggttgactcctctaaactaggcagagtagtagactagaaaaaagggaaactattctaaaatggttttatgttattgttataatctagatgtttttacacttagatgtttttatacttgtaatcaaataagtttgatgtagttgacagatttttaaaattttttaattgcatctgtcccacatttgctaatttgccaagggatgtgactcatacagcaaattaaagacagcctttcactatgcaacttgtatggtagtctggcctctttaaggataaagggtactacagatcattagcatgagatctattagctttgagcatctgcctgtcactcttccccagtattgtttaagctcactgccttgtttaacatagttatctacctggtttggtattactcagtttagaaaagttttgagcaggactatgcttgctgtattattatcctcacagatttttcacttagggaattagaagctatgaaatctttattccaaagcacgataaaacactgatctgcaatcagtatagtgatcttcctgtctttatgatatgagcttttccactgttgctgatgtcacttcccagagggaagtgaattttagtatgatgaacaactcccaaaagggggaagaaaatgaattattggcttttctatgcctgcatcaataagtgaagatgactgttcccttatctatacctcttcctccgccaagcaaaggaaacactcagtggaagaccccaaagtaaatagttatatgatgagggtctctcatgataacttttgatttgtcaaacaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggagtaagtaggctgatgtgttggttatacaggaaacatgacaatgcagtgcacaatgagtggccaaaatgacagtggagtttgtcaagtctgttaggtttgtagtttaaaaaacatctatgttcggtgactttttaaaattgaggtcgatactcattgtagctccctattcagaaattaggcagggaggagttccagctgcattctgggtgtcactacagaacagtggttctcaaagtgtggtccacgaacccctccctaggactcttccagggggcccacaaggtcaaaattatttttcttaatatttaaagaaagagtatcacttgcctttttcactgtgtcaacatttgaattgatgacacaaaggcatcgtaaggctgctgtcatctcatacagatcaggcagtggcaccaaactgtactaatagtcatcatgttccaatcattcgcagtaagaacaaactaacgaaataaccctgcagtctgcagtaccatggctgtctcaagggaacgcacctgtgtgacatttgtattttgaactagcctcttttttcataaaataccatcattatgtgagagaacaacagactatggtaattcagatttgggtatttggcagacattttctcaaaaatcagtgaaatgaactatcacttcaggaaaacaactgatagtatttattgaaaatgataaaatttaagcttccaagtgaaaattagaatcttgaaaaacttgtatctgccacatgagcttcacaacttcccaacccggaagacttttctaaaggtgctattaataaatgtgatttacttgtttataagtaattacctgatgaaatgtgtcaatatttgaaagacagtatattcagtgaatcagtattgtccagatgaccgatgcctgaatgccacaaaattatacgtggataaagagctattcaaaagtgtaagataggctaaaagattgtaatataacagtataacaagtttattgccatggtttcagattctatattgcaacttaactttaagcaactcactcgttgagttttggtgttgtatcaaggaatatccacagttatctgaacaggctattctaaaatacccctcccttctccatctataatttgtgtgaggccagattttcttcatgtcttcaaccaaagcagcacattacagcaaactgaatgcagcagcaaatataagaatctagtcaccttctactaaactaggtagtaaagagatttgcaaaaatcattattttgttttagaaaagttattttccataaaatgttttcaacattaacgtaaagtgggtttattatttttaatgaacatttttaaattccgtgttagtttctaatatgataaataccagataaatgtaactcagatgaaagttctttgaaggcctcataaggggtcttgtgataaaaaagtttgagactcatgactatagaatttctcccagaaatatgtgttctgcatttctttggcagtttcaaatattattggaataagcacctacctctgttcttgagatgagatactactttcaagctgggttttgcatttgctttgagaagtgatttttccaaacctggttttccattacttcatcatgttagttttccttaaccaaaacacctcatttttgctgttttgtcactatgtttcttttttttgagacagagtttcgctcttgttgcccaggctgaagtgtgcaatggcacgatctcggctcactgcaacctggcctcccaggttcaagccattctcctgcctcagcctcccgagtagctgggattacagacatccaccaccatgcccagctaatttttgtatttttaatagagatggggtttcattatgttggccaagctggtctcgaactcctgacctcaggagatccaccctcctcggcctcccaaagtgctgggattacaagcatgagccaccgcacccagctgtcactaagtttcttgttactcataatttgtctaaggtgaacataaattttcattatttattatacaatctttttctttaagcaggtgctgcatgatttcctcttgaatgtatttagtttaccaaacagattttggtgttttccttcccttcgtttgatttttgtgaagatgtcttaatgctgaagctgcttgcctcacaaaccctggatctagtttcaaacaataatgcttcgtctatattcagctcctgctatattccttaagaatcccctccctacaaatgggttggttgttataaggtattttattgcttatgatcctttgccctttagtttttcatgtttcactgcctgttagattcagatgatagtatagtatacccagtgtatggagtgtaacaaaaaaacccaaaagggttccagattttgggaactcagtctggagttccttataaaggtaatgaagtcacatcacgctagaacctcatcaggctacacaattatctaagtattacaaatgcaaataaattgaagttgtaacatgcagtaacaaatgcaggctgagttgtgagctacagccccagatgaaggctccagctctctgatgttaaagactggtcccaaatgtctaggtaggaatacctgagaagtggttaggaaactttcatgcctttcttgattctattttcagggactcttctgaactgtaattgggtgatttgactaagatagcatgatgttgtgcaaagactacaggctttggtatcaaaatggatctaggttagaatcctggccctatttcttagtagctgtgtgatctcacggaagccaattagccccatctgtaaaatggtgagattaaaatgctgtatagaaagtacccaatacaatgcctggcaaatataatcacaaaatccatcattactattattgccaccaatgttaccctttcagatgtgccttcccttgcaaatgaacaaatcagcatcctagtcaattagcaaggatcagaacctccagagccaagagagggcatgataagacagtgtctgaagctgcagagcagatgataagttaaagccattggattaaattccaccagggtacagaccttgtgaggcaccacctagaacattctagttttcctaatggcaaaacataaggtttgcccttaactctgttgtacaaattttggtagcatgtgctctttctcagaatccgtcttaagcggcacaagccatggccaaggttctggtcattttgctgctctcttacattcaggtgtgtcatttttgtagtacctatatattttttagtataaaatagttatttccttctttgcaaatagagataattctatttcaagttcttgagtcatttactggctcatattttagtttttgcttttcctcagccttgtaattttgttaattgtggcttaaccaggcatttctcaaccttagcacttcaaaggcaaccagcccaccccagggagggggatgggaaagacagttaagaggatcgcagttcctatgtggactctttcctgttagcacaaaaagtccagaagaaagtagctaggggactccagctactgtgtgcacagactcttccatctctatgctgttgcagaggtggaccatctaatcctagagcccgctagcctcaggtgcttcagttccacttagctattttttagtgtttatggcagacaattttggttgacattagttctttgtgtgagctgaaatgataggtattctaggaaagcatcatatgtcatagctgaagaaacactaggcactagaggctgccttgtttttacagaggagaaaactgaagaaactgaacagagaaatggggcttgtctaaggactattgattatagagtcctttggccctttggccattttgctcgttttttgttttcttgtctttgttctttccttcctcactgtacctccacccctcttttttgttgttgtttgatgcttccaggtctggtttcctgctacctactgactagcaaccatcagattctctgtaggacagaagacagaatttggcatctcctgccttctggtagtcagacttgttgctgaaggacagaagcgccctccaaagagtgccctgtttcctccctgtattgcaccatgagctcatacctagtgtaggatcaccactgctcgtctggagattagcactgcagcaacctcaggtacccaaggcatattggggcctgcagacatgtggctaggaaggaacggaggtagggcccttcatgcctccagacctcctgcaccttgttcattccatttgcctggaaagcatcccatgtcctacccgagaacaacttattaccatagattctctccagatagcatggaccttagagcatccctgtacttcctgcttagcatacagccctccagtttacccacttctctgtgaacctctagcacttcctgagttgcaagataattcatggttttacttgttaggttctcactgggttgtgggcttccagagggcaggactatcttgttctttgtcgctcctatccccgtaccaccccagtgtctagtacgtaggaggtataaacagttgttgaaagaagatatctgtaagttttacttacagaagaactgattctttcagaatatctaaaatgagatttaaaaaaatcattttattgaaaacatcagttgtcttaaaattataggagtttccccccattttgcatttcttcaatgaacatgtattacttgagcaataatttttagagtgtgacaaatcatcagaagctggggtccgtccactgcatgtaggctgccatggtaacagcaccgggcccaccctccagcacctggtcctgaatcctaggctgggcctctaacaacagaggaatgccccagtgtctgacaggaagaagcactaacagcctgccaactgctgaggaacatcaaatagaggtcaggagccgcaaatttaaactcagtacttctgctgtggtaactcaagtaaccctccgtttaaaccaggacagacctatgctgacaaccatttttatcactcttagtggtattttctttctttgaacatgaatgcatatttctgctctttaatggcctttggtatttaagattacattcagctagtctccttattgcatgttgttttattccagtcccaccagcactcagaacaacagcaagtgtgtgtaacagcgggcacaggcgctccagacggaaggacctcactgacgcagttagctcaggtagagcttatttctgtgttcaattttcttgtcatgagaagcagtgacccctaagaatttgtatccctttgttcaattctttgttttaggagagaaacttctaaagcattactctaaaaggtgatagagacagagacgggccattttcatctaccccttgcagagttaagttttattacagtaagttgtgaggtgagacatgatggctgcaggcacatagtcaagatctaccctcctaaggaaataaaacggggaaaagtggttgaatgtccaatatagaaaatttaatcaccactttcccaaaaaagaataaatggaggactccattgtaattatggaaatgaaatttgggaactattttaagacaaatatcaaaatgaatgtggattcagatctacaacaatttctatatgggtagattgttagtactcagctaaggatgtgaaacccaggaggattcagctgttaactcagacttgctttcagacagccccttgccccctgctgcaaaacctcttcattcaaaactatggttgtgtgacgtccactctcctgggagctctgcaaggactttgtctccccctcactgcattcctcattgcaggtgttcaagccagcagcttctgcttgccacagaattctgtgtgaagttcatcaatcttcaagtatgatttttttttttttttttgaggcagggtctcaccatgcctcagcacccagcaggctggagtgcagtggtgcgatcttggctcactgcaacctctgtctcctgggttcaagtgattttcctgccttagcctcctgagtagctgggattacaggcgtgtgccaccacgcccagctaatttttgtatttttagtagagtcaggatttcactgtgttggccaggctggtcttgaaccccagacctcaagtgattcccccaccttgggctcccaaattgctaggattacaggtgttagccactatgcccggccacattttcttttaatccctccactaaactgtactatcagtagtttaaaaaaaaaaaaaaaaaaagaaaaaaagggttttctccatctggcttgccactaactcaaaataaatggacaatcatatagaataaaaaactcaagaggtaggaagactaagaattcatgtttatttcttttaataaacccctaactatgaaaaaaattatttgtccagcagcaggactaatgcccatatttgcattggggttaggggctaactgaatcagagaagctgaggaaaacagagctgcaataaaacaataagcaaggcagggtgtgatgtccttatttaggaaatatcaattgctagaaaaggcatacctttgcccagtttatttacgtagtatggaagaaccatatacaaatgagaaaaagcatgaagcttggagctcagatacattacttacttgctcttatcttttggacatgtcattctatgtaagttggtaaaaccttttggaaggcaatttagcagtacatatcaaatttaatattatgttagctataatttcatttcaactacacaaatatacatatgttcatcacaatgcttaagaaattggaaacaacataaatgttcatttaataggatattaagtgaggtataaccacagatgggatagaaatgcaattaatacaagggatgtaggctgcacatggtggctcacacctgtagtcccaagcactttggggggctgaggcaggaggatcatttaaggccaggagttcaagactagcctggcctaacatcatattgagacccccatctctaaaaataaacaaaacaagtgctgtatatcccaagtaagtttctgttacagagagttcctggagaaataccagttatgtacttacacactaaaacatgctatccacgtaaagaataaaaccacctacctcacagaattaatgtgaggagtcaataagatgaccaagtcaatgcaccaaagtaagtggaccacacagaactggagcccatcatcgtcatgtgggactgtggatccggtgttgccagatcttccaaattgtcaagatttttatttgaactctcctaatatttaaacgttgacaacttattcaactggttttaaaacactgcaggttaccaaagaaaacatacagatgacaaataagcatgtgaaaagatgctcaacattattagtcattaggcaaatgcaaattaagaccacgatgagacatcctgcaaacttattagaatgcctaaattaaaaacaaaaagaaaaactgacaataccaaaccctggatgggtgagcaactacaactctcatctacactgctagtggaatgtaaatgggacagccactatagatgacagtttggcagtttcttacaaagttaaatatacactcaccacatgactcaatcctaggtatttactgaagtgaaatgaaaacctgtgttcacacaaaaacctgtaagggaatgtttatagcatctttattcataattgcaaaaaaataaaacccaaatgtccttcaactggagcacagataaccaaactgtggcacatccatgcaatgtaatacttattcagcaataaaaatgaattactgctatactcaacatcatggattaatcccaaatgtattcattatgctaagtgtaagaagccagattcaacaacgtattatgatttcatttatatgacattctggaaaaggcaaaactatatggagaagagatcagtagttattaagggttaagggtttgacggtaatggttagcacaagggtcacataaaggaatttttttgggaagtgaaagaaatgttctgtattttgattgtggtgacagttacacgactatttgtcaaaactcacagatggccagaaaaagatgcgtgtgaactaatgtcctttgggagtctgtggcctctttcttacattcagaatgcagctagcacatagtaggctgctcacatccactctgccacctatgctgtggcgaagatgaactgagctagtggagctcattcattgatagcattgataggtttgttttcaatccacaggttatcagcacagtattcttcattaaagtagaatctcaactttgcaaacatttcatcagtacatttgaaattctttccttagggcaacaagattatctcacatgctatgtgtattcagaatacatattaatatacaaaattgtaaatgtaacagtaaaactatgtaaaggaagcctgtaaagctaattaacactaatttttttggtgtgtatttcgctaatctttccttaaagcactatttgcctgtgttctattagccaggtattgcttttacctgtaatctgtaacgacttttctggtatccctgcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaacaccttttatcaatgttttatttttaaaaacaggtgaatccacttttttatacatcattgcacttcaataattacacaaaacacacaagtacatgcatctacaattacgcaccgcatgagaaccgttaggttataaaatctatcatcaaccagtaaatcaatgtgaaaaaatacagtgtcaaaccaaaaagtataactatagttgcatagaatattaccatgctataacatttcaaggtcattggaaacaaaagaaaaattataaaagtttgccttgattgaatgaatgtacaagaataaggttcaacacatcagtgcaaaaggatttatgaatttacatgacttaacagaagaaaagataatcacttaaaaagcaatcatacgtatatactgcaattcattatacccattcagtggactgttccagcttattaaagtcacaggttaagcccttaaaattatagatttcagtttatattactcatctttatgtaccagaactgcacaatttcctcatctgacaacatacaataaggaatgaatatcagcagcttaaaaatgaaacaagcatttactttattttggatttctcccacccccaaaaatataaatatatatatatatatatttatatactgtatatatctgtaggttttgctgtactttacaaaagtgtatcactagatggcagcagtgcattttagagctttgccaatttaacagctgcattaagtaaaaaatggcgcatgcatgatctgatcctcagaggaccttttcacttctatttaaatattttaacaaaggaaaaaaaaaagcaacattcacagcacatcaagcccaaaatagtttacaccttctacactgaagcattgtttaaaatgtacctggctagatcacccttacaggagaggctaaataaggcatgctttagacagtcattgtggtgttgctcacttgaaaggggagagaaccaaagaggtccaagcagaaaattttagcaggtcatgttgccaccagtttcaggaacctaaagatctgtaaagaaatatgtatttggaaattataaagggattatgcactgtcactcacaactacaccgtgtgccacacaaaactttggttcaaacagcacgctcagggatgtggtgtgaaattctgatctccatatgcctaacaagatgacattctggccctgctgctacctggccattcttgtcttgcccccagacgtgaggtaagactagtaggcctctgggaataagccacctaagaaggtgacaattttcacctctttgtaaagatataatagtagtgaaaagtgttgattttaaaatatgtcttctgaaatggcatttatataaacatgtgacacaatgcacctgatggcggggcacactggctcatgcctgtaatcccagcacttctgggaggctgaggcaggcggatcacttgaggtcaggagttcaagaccaccctggccaacatgatgaaaccccgtctctactaaaaatacaaaatttagctgggcatggtggtgggcagctgtaatcccagctacttaggaggctggggcaggagaattgcttgaacccgggaggcggaggttgcagtgagccgagatcacaccactgcactccagcttgggcaatagagtgagactccatcttaaaaaatccaaacaacaacaaaaaacaacgcagctgaaaaatgttcctttccagtccctaaactgggcagacagaactggcttcatcagtatcagctgctctgaaatgaactaaaatatcttataacaccaattactgaagaatttgtaacaaggtcaatagaggcacattcatttgaatataatttttaagactgctacagaaggccatacttacattgtaagcagtacttaatttgtgtttctctggcgcaagtttttatctttgtgattgttggtagagttggttttcctttggaggaaaaattgcattacatgagttaaactcagtcaataacttttcaaagtataacacatggaaatacagggactctttcacttactgccatccctggtgtagtgagaaattttgtggcacaatatgagtgcataaaaaaacattccttaagtagctacaggttaagtatccctcatctgaaatgcttgggatcagaaatgtttcagattttgaatttttttagattttggaatatctgcattatacttaccagttcagcatccctaatctgaaaatccaaaattcaaaatgctccaatgagcatttcctttgagcctcatgtgagcacacaaaaaaaacttcagattttggagcatttcagattatggattttggtagtaggtagactcaacctgtatatacctcattttatcctccttttgacccccaaggcagacgagtactttcccttcgaatccggaactataattacgatacaggtgagaatatgtaaaacttttctccactgaacacaacaccactgtcccttcttgataaaaggtaatcataagctggcagtgctgggccctctggtacttaacaaatttgggtgctgtttgtctgcttctcactctttagtccaactctaggagattctgccgatcttagattgattccatacctgcagtaccctctctcttggatacgagcaattgttaatggggctagacagtttatccaggctatagttcagcctcaaattgcattacatgagttaaactcggtcagtaacaacttttgaaagtataacacatggaaatacagggacccttttactaccatccctggtgtagtgagaaattttgtggcacaatatgagtgcataaaaaaacattccttaagtagctacaggttgagtattcctcatctgaaatgcttgggatcagaaacgttttaacattgacaaaaccgggagcctcagatatactggccatttcccccacattttaagtatatcaaatacacaaaatttgaaaaaaaaaaaagttttttgcatggtattccactttgtatggccactggaaaacaagactgcataacctatcctgagaatcaagtggtttttagtcagatctgtgtcaagctaagaaatctacactgcaaccttcatttccactcactgtcttcccctccaatcttagctactccatttgattaaactgcaaacacaacatcattcaatcagatactgttgaatcaatgtccaataaagtacttacattggtccagctggttcatcatctacatggtgttcagttttttaaaaatccatgagagataagagaagaaaggagaaaactgttagattctgcataaggattaacagaatagcaaactgcaagtggcaatcatggctactcacagcatttattaaaggccattccatctggaggtgcaaaacactcatggagttattatttctagattcaagtttaaatggcaggtatgttgtttcaatggttttagttaacactttgaatgcttgtcatgaaaaactgcaactgtagcggacagataggctgcaacattgttatactcatcttgtccccaagttccagtggttcactcttaaatagatgagaagacaaaccaacatttcagttgtaaaatcctgctgtttgttttcttgtggtgaatgcatgcagttttggctcaatcctgcaatgtgaatggatgtgtaccatctgtacatttagccacacatcctcacttccccaaagggcactctgtttttcttgctgttttgtaatctttagaagagtctttagtctggagaatgagattgagaagaggcaatcacaatagttcaacctaaattgggtcagccatgctgggctatgccagcaacaagtgtatgtataccagaggatgttctgtgacacaccgaggaaagctgaacagtggtgacatccctctagaaaagacttcagaaagacaggctcactcctgtgccctggccaaaaccagaagccaaacccaggggagccatgagataacttttttaaaatcaaaaagctgacattatatgagtttaagccttcttaaattgatactttatgattctgatttataagtctttcgtgtttcaactaagtgcaacttgatcccctttaagcagagatacacattcacagagagagaatgttttaaaaagacccacaaggggaagggaacaagtaagtgctcttagtttgtttttattatacaaaagtcaggtaaactaaatgattcagaacagtttgatttcactgaaggcttctagaaaaattctcagcaggattccacaagggggcttggtgcacatgaagcagttatggagattacagtctcagtgtaggcatctgcaggagcacatgtcgggagtaatgtctgtcagagggagacattgctccacctgttccttcgaggcaacggagaggcaaagccaccgccagcacacacagtgactggagcaaaaaaggatttcaaaaaaaagaactaaccacaaaccaatgactcatcagccaaaacaataggctagcgacacactagtgtccacaggagtccactactaacaacagtatacactatcaaacgggtacagagaacaaactaagacttaaggacacccaagacatctgtgtgctgtgtatgcagtggagagatacaaagacataccaggtactaagacacaaaagcccagcctaaattctcccctcacaacatcctaatgctcagcatcccggccaagccagctcagctacatgctaggaactaagcactttggggatttaaatgaaaagacataggagcaaacttggaatacttttagtgctctggctgtgcactcgaaaatacaaaattctaatgcaagagagccgaatcaagaatacaccaatctactcccaaatttaaaataaaaagcaggggagggagaatcgcaatagccaggctaatcttttcaaagcatgacactgtaggcaccaacccaagcacctcacaccacgggctgtttttccttttggagtgtgggtattccctggtgtctgattagtaatgtcactttccagcccaacaagctggtaacatgcaaagggttgcatggaggtgttttagcgacagtgcctccggcatagctgccatgcctgcaagtgggagcagttgagattcacaagggggcaaaatcccaggagccctcttcatctgtctccccaaatccactttcacactgacaaacaaaagagcctcatgtctccccactctcctggactgaatcactatctgcagcaccactctcccctacaggtcagacaaaaaaacgacttgacccctaacagggaagtcaggggagagggaaagaacagaattacagaaaaaagatacagaaaccaaagtaaatgaggattaaacagcaaactgaaatccaaattagttgtgaaagtgaatgaagtaaacttgaagaaaagtgttaacattatgaactgtgcatcgtatagactgaagcggagattaaacaaactccaaaagcatgcatatcgctcacttaccaccatgttttaagggtttgatgcaattgaggggggaaaaaaaagaagtcatagtaaccgacaaatatcaacataccccaaaccctcaggccaaaagatagccagcttaaacaatgactgttctctccacctcagtattacagccactggctagatgagaggaagaggactggggggataatggaaacaagatgcttctggaatccaccttatgagagtgaagttaccggtggaactgtagcacacactgatttatctgcgtgttccatcttcccaaccgaatggaccacagccctcactccccctatatccgcctcatcatctagaaggggtgctctgcaatgtctagtaaataacggattgcctaatacaatatcacctccaaaaagatggctttaaagtccgaataatgaagagttgactctctggtcaaaggtcctttgtcactgcattcatctcactagaaggttttatggtttctaaatccacttaaattttgcctgaccttagcaggttagcattaaacccaagagagactgagttacttcctatttccttccttgtttggtcctattgcattttctccatgaggtaacttgttattgacccagatggcccctagttaacagaccagacaccgaatgcatgttttaggtgtcattttaaaagtcacatttcttttccaatatccctagtctgtataaagcttcatatgctaccaaatgttttgaccaacgaatagattttggaacattagaacagctcttcattctaaagtgtctaaaagagcttggatatatcagagccactaaaaatggccccccaaaaaacctcaaatatcttctccatcagtaacttaaagagagtccctttgacttgcttataaaaaattatcccaaggtaaaaacagaaagttcttttttggtaccagcacttcttttcttaaatcagctcctgttttaatttgctgtctgtgaggtcactaaaatatccagaagaactgcaggcctcagcaactaagtgggttcactccccattcctccagggcctggggaggggagactcaggagcacaggctgactgctcctggagtgcagtccgcaggacaccaacacagaaggtgcacccaagcaggtgcccagctgtgacatggatggaagcctagaggctgctagcttgacctggtctttttagagaactatcatttaacattttcagggaatacagtcaagtggtgagtcaagtgaacaaaacaaagctcttatttgactccatgattcacttgttcctgaaaatactgaaggtaaaggtgatctgtagattagtccacctacaagacaacctagtgggcactgatcctcaaagagaccatacaggggactaaaggaatgcaggtgggtgttttcatgtaggaaatggtctgagaatactccagtaggtaaagaaaaaagacatggggctttttttttttttttttttttaaaggaagcagctaaacctcaatcctaagcattttcaatgtgagaaatctaaatatttgattttctagtgaaacatacttaaactaaactatgtaagttcaaatttgtgcttttatacttttgtattgttcacttagtgcttttgtagtaaggggatgagttaccaagaactcacagactgcccaaaatatgacgactgtgcattcatataaaaaaagttcagtgagtctgaaatgagccatgggtgtatcttgataataaagtgctatttggcaaagtagaagtatggcaggcctataaaaaaattcccattttcctaatggtataaaaaaaatccaacacagagccacagatggttatctgataggtaaacacttatgacctcttaacactcccaagtttgtgtcaaatataatgtacctcttcgtttattccaaaaggagtgtacgtatatatctatatgaaaatttggggagaagcacatgggaaggaagcagacaggtaagtttgtccttcctatggagtgcacaggggttgaggggaactggctaaagaaggaaaaggcagagaagaaggaaactcaccaaagaacattcaactttttcttttgtttaatgattacttccaggaaaggagaagaaaagcgggcaggggtggaagcaggatggagtttgagagaaagacagaaagagacagaggagaaaaacagaatggaaatactggagcaagggcagggtgtgaagatggagagtggagcctggcccacactggctgtcaggaagggaaggagagaaggcaaacattgccatcattccagcatctcagatttttcaccccaatgcaacaacaacgaagtaaacgctgctttcattacaatactctcccaagagactagagcaaggaggttttactttgcacttaccctgccgtcatctcttttaagggtaggattcattcactgtctataataacttagtttaaaagaggtactttccctctaggaagctgttcagatttgctggccacagatgtctcctataacaaactggtcccccatttgatttcagtaaccaagaaaactcttacaaaaaaagagctgcttccctgggcaggtgtctgcacttatccaacagaacaatcctaaccatttctcaaatctaacctaccacatgcactgtgatagcaacctcataagcgcggtgacttcttagggcaaagactagacctctgctgggaacacgctaggctgctgcatcactctcaccagtggcagccagccttgccttaaaatttaaaaatcaggttctgaagtccatctctgccttctcttacctgactttttagcttctcaacctttccaaaaggcaggctgaggaaggtggtattggcaaagcaaaagcattctggggggataaaaaggcccttttcaggaatgaggcataactgatcccacagagccaaagctgaaaacacacgaaagacaggcaactctttccctttactcccaggtctaaataaaggtgcactcttgccttgggagtcctaatatgtagcaggaaagaaatacctggagagaaaaagcattaggagtacatgaaatcccaaagaaagcaggttcacttcataaagtaggaaagtaaaactcatggggacactcccaggttgcaggaaactagagattcatttgcagaggccgtctgctcccagccaacgtccttcccacgcctctgcccagctcactgctgagtgcacatctggagggagtcaccagatattgtcagtgtcatcaacaaacctcctcaccagccactcactctacttactgcaggcagagagatttataactgctgagaagaaaggaaaagatggggaaggggctgttgctctcaaacatgtcctcccagagagtctaaagccactggcatgcctctggggccacattctttctgagggagcaccagatgtcactttgtattctccactggacagccagctctgtggggcaggatacagcaccacaggtgcacaaacacaggccccagaacagctggactacagctggcaaccccaccatcaccccgggtaggctaccactgagcccaggggcacacccatctgtctagtctagccagggacagactagtggtggtaacagtcggccaattaatttctgtacgccggtcatgttatagggtggggatggggagccagctgggaacctgaagtactgcagatacaagtctccatcagcagcttcccccttcacaggaaaaatcgatcaccaaaaatttcccaaggcttttctgactctaggcatatccaataacctaagatttcagctcttgctctttccagtgctcagtggtgtgctgtggttctgctgctaccatctcctcccttctctgaccctaggccagcttgagggcacagcctcggggcatggactccatttgttccgcctttgctatctctgtcttacactagatgggtggatacatcagactctcctttgtctgtgagacacagatggaaagccacccagcagagagcgctggaaacctatcaaagggaccaaccaaggaaccaaaagctggcttgttccaatggcttttctgagaacagtctgactgggctggggcagttacctacaggggctacaccaggcaaccatgtgacaaccagttagataccttaaatctgcctgaaaggccaggtggcctgccatcttggggtggcttctaggcttgacttggattctcctcaagctcaatctgcctgatgatctgtattgaaggaggacagagctgaacaaagagactgacagctgcccattcaccacatggggcctgaaaggcagatgggactagggtttggaaaacacccaaacagagggagagagctaaggacagctctagatggctaatgcaaaaaaaataaaaataaaataaaaataaaaaataaaaataaaaaactcttacgggtagggggttaggaactggtataagaattttccttctttcctttagggattgaatcccaacatccctatagtcctctttgggtacttggaaaccacccgaaggaaccaaccccagcagtacagctattttgtagggatgctcttaccgtcaggaacctcatctggcctcttcctcttctcatacacaacaatgatcaccacaaggatgataatttcagccagaattcccaagaaaggccagagtggggccaggtggctccgcaccctgaggacagtgacaacagaggcggagccaatggcgttggtggcattacattcatactcgccagggtcttccgtgatctgcaggttcacaatgttcaactcagtgtaattttccttgttgatgatgaagaagcggccagaggtattgacaatgtcctgcaaaaaagtgagaatacacaaaggtgagagtgagtaactgagctaatgttcaagagagggtgacactgctctccgttctttttaggcaccagccagaatgaggaagcagtgtctaggaacatttcattaatgatttcccttcagtatcaacaacaacaaatcaacttctgacagagccaggcaagcctcccttaccatcggtcctccagacttccccgacttccacgaagtgagtgcaggtcctactgcctggagactcagaaaagtccaacaacctagtaaatgctgcctccaacaccaggtaagaaaccacagcagaaagaggacggcagaaggaggggtacaacccctacagtcaggcatgcctcggggacctcaggcctctctgatgacctcagagtcagcacactgacttcacacttggtgagttctgaggaagtctccttaaacttcctccacaaacaatgctaagaactcactcctagtcagactgggggaaattcataactttcctttcatttaaggactagaggttagaggaaaggttattcaatcaatcaacaaatatttgtggctgggcacagaggctcatgcctgtaatctcagcactttaggaagctaaggtgggaggatcgcttgagcccaggagttcaagactggccttggcaacaaactgagaccccatctctacaaaaaatcaaaaataaaattagctgagcatagtggtgtacacctgtggtcccagctacacagaaggctgaggcaggaggatcacatgagcccaggaggttgctgcactccagcctggtagacagatcaagaccctgtcttaacacaaaacaaaacaaacaaataaaagagaacaaatatttactaaaatatgctgcatgctttatatcctactaagggcaggtgggagtgagaaggtgagatagggagaagacagacctagaaatgaataaggagcttggcctcaaaagggaaccagacatccaaaaagggatgactgatttcaggaatgtgttaagaagccccaacagagcgtgtgtatagagtgctgtagggcacagtgagtggccactgctggaaagagtcagggaaagcttcacacatgagctaacatttgcactagactgtggaggaggacagctgatcaaacagggaggagcagtgcaggcagggattcgcatgggtgtgaaggcagaggtgcaagagtgcacaggcagaggtcgggactcagcgggatggctcactgcactcagctcatgagatcccggcagggaaaaaacagactcatgtgtctttaccctgcaacaactaaagcacaatcagaaataggagagaaaaaggggaatattatcctggaaatgattctagatatggcatacaatcttgtcagcatttgagtgcaggtacatctgaaatggggaactcgtaagcttttaaaacagctagtctgtgatgcctcaagcttcatctttcagattaaaacacatactgcgttaattccaacctgctttggcaaaagctcaagggcactccttcccagtgaccagcagagagaagtggacatttcctctccagtgccttagaaagttcagtgtcttgtaaaaaagactcagcatcttcacctcggcaatcctcatcctgctcctcgttaacgggtctctgaaatcatcgctgatgttggagtcattatcacaactcaacattttattatcaagatgtcatgaagtaggaagaataatggacttgaaatttaaaaaaactagatacaactcttggttttgccactaatttatcttggctactatggaacccttccaaagaagatggattaatgatctttaaggtccttttggattctgaagactgataatcaaagaggatccatgggatcagaggaacgcttgacacgctctctgacagaaaaggtaatgggtcaacaatcataatgagagagaaagtgaggttctaaagctctgactctccaaacaacatcatgaatcatcccactgatcggaaaagatgttctctttgacattttctggggcaaataccgtcaggttcccaatgtctaaggctgccaaggctgcccttgggcctcctcaggttgccccgattccttatcagtatgttctgtgttgcaggaatgtactagtaattgccctcagtaccttgggcctcctcaggttgccccaattccttatcagtatgttctgtgttgcaggaatgtactaataattgccctcagtaccttgtttcctactaaaaaaacaaggcaggttctctaagaccacttcaaaaacagtattttcttcaggataaatggacgagaattaggctcggttctttcagtgtcctatcctgaaggcaagtgatatggtttggattttgtcttcaccccaatttcatggtgaattataatccccagtgttggaggaggggccttgtgggaggtgacaggatcatgggggcggatatcccctttgctgttctcctgacagtgaattctcatgagacccggttgtttaaaagtgtgtagcatctccctccttcactctcttcctcctctccagccacctaggacctgcctgcttccccttcaccttccaccatgattctaagtttctctacttacagggatcacttaagaagaaataaacagcaactgcagtctaaaaaataggtaagtttcaaggatcaaagaagcctgagggggaggctaattctttggatttagctttatcttaactatattacctgtcaatgcctcaccttcagttacagtaatctgaaagcaataaaactcaaagcaggccagatgtcactctgttgtctaagataggaaagatcatctttcctgtgtttcctgaggcctccccggcaatgcttcctgtaaagcctgtggaatcatgagccaattaaaccttttttctttataaattacccagtctctggaagttctttagagcaaagtgagaatggactaatacagtgagcaatctaatctcttaccagagggacagctttaacaaatcacgtacagggatttttgtgctggaagagactgtcaatgacctcttgattcatgctgtaaaccgtgactctagaaagggtgaccctcgccatgcacacatccgaggatacagctactacagtaactgacccacgtgtctggacctctgcagggaaaactccagcaaccagagacccgggcctgcctcctactcaccatgggcatcccgttctccttcttgcgccatatccagtctgggtgggggtagccaactgacttgcaatacatagtggcatcctgcccttcattcttgttctcactccgtttatggccagtgatgtcaggagcggctgtgagaaagcgttagacgcagttaccacggaagtctactccaaacaggatacaaaggccccaccttctggctcagagccctgcttgtaatgtagtcagtctttatgcttactgtcatactcagctttgatgaagagcatttcaggtcagaatagggtaaagggaccaaacccatcctctaccccccacccgctaaagatgcccaggcagataccagggttactaatatatgaggctctactaatgtaggtgattctccaacctactggaaaaggatgcaggtccaactgccctcaattaagcctacctttaaagaaaatgcaaacaaacactattatctcttctatcggcccaagttttttcttaaaacacctgcatgaacaacagttatgcatcctgtcaaatatcacacattcccttaaggaaatgagattctgagataaaacaactacaatcaagtcctattacaaggtatgtaaaaacaatgaatgcttggagaagctactcaataagtaacaatgaccaaggctctcccaggaaagagggaatccagaaactggtcttcacaaggaggaagaaaggaatgaacaggaaattcaaccagtgtcccaagagattttttttttaattgaatgactgattgagatggggtcttattctatcgtccaggctggagcatagtggcatgatcgctgctcactgtagcctcaagctcctgggcttaagtgatcctcagctcccgagtaactagaactacaggcacatgccactacacctggttaatttttaaatttcttgtatagacggggtcttactatattgcccaggctggtcctgaactcctgacctcaagtgatcctctcaccttggcctcccaaagtgctgggattacaggtgtttgcatctgcacctggccctaagaccttttattaacaacttaagaatctgccttggacacctgatttgcaacagtttcctagactgaacccaatatagaaggaatttcaagacatgctagaggccgttggtcttctctatttatagggatcacttaggaagaaataaacaacaactgtagtctaaaaattaagtaagtttcaaggatcaaagaagcctgagataaaagcgaattctttggatttagctttattttatcataactatattacccgccaatgcttcaccagttacagtaatttttttggagacagagtttcgctcttgtcgcctaggctggagtgcaatggtgtgatcttggctcactgcaacctccaactcctggtttcaagcgattctcctgcctcagcctcctgagtagctgggattacaggcatgtgccaccatgcccagctaattttgtatttttaggagagatggggtttcatcatgttggtcaggctggtcttgaactcctgacctcaggtgttctgcccgcgttggcctcccaaagtgttgggattacaggcgtgagccatcacgcccggctaattttgtatttttaggagagatggggtttcaccatgttggtcaggccggtctcgaactgctaacctcagatgatctgcccgcctcagcctcccaaagtgttgggattacaggcgtgagccaccacgcccagccgggttacagtaatctgagagcaataaaagtcaaagcaggctggatgtcactctgttatccaagataggaaagagaatcgatatgccttggtcccaattccagttttgttggttctttcgttattctgggctttgctgctacagccattatcaaatggagacacctcgtgtccttgtctacctcccagtgttcttgggtagatgaacaggatgtcaaaacattcatcttgagactgtagaagcctgtactattgcattggggctaatctcatgttccacctttgactggcttggtttttcttggcttaaaaacaatgcaaagtcctactagtcacagaatgtgcttcccaggcacaaactggttttagactcaccctccagaggcacctggatgggcatgcactgggcaaggccccaagctgtctctgtaaccagtccctgccaaactgaggcctgctgagtaacactcagtgtgaagtgttttctagatagtacgtttcaaaggaaatatctttttttttccaggcaaagtttcttactacagaaggaagtggtcaacctggctctatctcattcccacaaagccgaacttttcccacagctactcagtcacttcttaggctgactgttcaacctggtcaccctttctcagagcttacttcagtccataaattccaagcactccaaggagcaggctccatagccacacaggacccagcatgcccgaagggttaccatgtgctgctccagccagccatgcttcattcatctggcaaacacctgctgagcacccactacacaccagatatgtcagactggttgggtaaggcttttgtgatgagatgaactttagcatggtcgtgaagaaaataagggagtatatacaaggttcctgacctgtggtaagtaaagaatgtattttttcttttttgagatgcagtctctctctgttggccaggctggaatgcagtggtgtgatcttggttcactgcaacctccaccttccgggttcaagtgattcttctgccttggcctcccaagtagctaggattataggcatctgccaccatacctggctaatttttgtatttttagtagagatggggtttcaccatgttggccaggctggtctcaaactactgacctgaagtgatccacccgcctcagcctcccaaagtgctgggtttacaggtgtgagccactgcgcctggctaagaatgtcactttctaacaggccaggaaccccaagttatcttgggacctcaagaggagaggaatttgcccaactcgtaagtatttgagggtacaaacccatggctgggctcgactttttaacagtcttatctgagattcttcatggaacagagttctgtcaaagccaatttaaaaagcctaagtgaaaaataactactcttgctgcactttatgcaaataatcaggccaagtacagtaagaataagtttattttataaataaatcagttctatcatgatttgtttttaataaaaatggggactggagagagaaaaattacgcttcaaaagaaaaactatagtatactgttgttagctgttcttgaggtttttttctgcagtttagatgaaattctaaattctttgtgggttggaagtccccaaactaatgctttcaaatctttgcttttaaaattgggaattgtactcctcatcctaggactcgttatttaccttacagtaggctgttcacttaaacactgtagtaaaactatagatgagagtagtaatgtttttcccacacaagccttggaatcctagccaggcctgcatgagtacactcagacagttacaaggtggttccactcttctcaccttggggttcactcccattcccacaatgtcccctatcagcaggaagaagccagagtgatctacggccttttgccatcttcagagcctacaccttaagattaaggtgttataaaacccaaagggagagactgaaaccgtctttgcaaaattatgactgagacagggaaagagatcgaacttaactgcttcatcttacttctaacctccaagctgtccttgttcactcctgggcgcaggctgaactaactttgggagaaacttatagtttaaacaaagatggtaacaaccctttcccaaaacagactcccttcttgcctggggactagattgcctttgtagaactaacattagacacaagattagaaattatggtttaggagtcatgcagctggaagctacaagattctgaccctccctaaactgctcctaagatcagtgcttgagatattttgcagaccttgcacttgatggatcagctggccccacccagatcaataaactggctcatctgatcctgtgacccccacccaggaactgactgagcacaagaagtcagctctgactccctgtgatttcagctctaaccaatcagcactcctggctcactggcttcccccaaccaccaagttatccttagaaactctgctccctgaatgctaggggagactgatttgaatagtaataaaactctggtctcccagcaaaaaagaaaagaagggagtaggtcacacatatctgtaggaagaacactctaggtcgagggaaatgcaaaggtcttgaggtaggattgtgcttgttatgtacaaggaacagcaaagaggatttgattggaacatagtaagcaaggagaagagagcaggaaataaaagaaatcagagagactggggacccagattagacaggactttgtaggccaccataatgactttggcagttacagtgagtcagccgggaagccactggtgaatactatgtgcaggtataaaatgatgggtgtgttttaacaggctccccgtggctactatgtgaacaagaactgcagagacagcagtggaagcaagaccaagcaggaggctattacagtaacccaggcaagggagaggctggtttccatgggggcagtaacagtggaaataaggagaaatggtgagattccaggtatattttggaggttgagttaacatatttgctaatagattgaatgtggactgtgagaagaaaaggagtcaaggatgacaccaaggttttggcctgtgtaactgtgagaatggagttgacagttactaagatgaggaaaattgcaaaagaataagagtgttttttgtttgcttaatcttagtttgttttgttaaaagactgagaaacagtggtggtaaaaaccagaaggtcaaggtctagaacatggtaagtttaagatacttatttaacatatggctaggtgtggtggctggctaggtgcagtggctcacacctgtaatcccagcactttgggaggccgaggtgggcggatcacctaaggtcaggagtttgagaccagcctggccaacctggtgaaaccttgtctctacaaaaatacaaaaattagccaggcataatggcaggtgcctgtaatcccagctacttgggaggctgaggcgagagaatcgcttgaacctgggaggtggaggctgcagtaagccaagatcatgccattgcactccagcctgggcgacagagtaagattctgtctcaaaaaaaaaaaaaaaaaaaagatacttatttaacatccaagtattgggaaggctgaggcaggcggatcacgaggtcaggagatcaagaccatcctggctaacacggtgaaaccccgtctctactaaaaatacaaaaattagccaggcacggtggcgggagcctgttgtcccagctactcgggaggctgaggcaggagaatggcacgaacccaagaggtggagcttgcagtaagctgagatcgcgccactgcactccagcctgggcgacagaggggactccgtctcaaaaaaaaaaaaaaaaatccaagtaaaaatatcaagtaggcagtaaaagagcaagtctggagttcagggaaatgttctatgttagggatataaatttcaggtatcagcttatatgtggtacattttcccattttcattctcctttgacccaaagaagacacccactttgggccagttattggcaatagtactatgaattcagtactatcagcttttgctttggggactcatttccaagactgtacattagaaccatctagaatgctaaaagttgagtcggcagctgcactgcctctgaaaagtcactattctgaaaggacccagacttaaaggtcaagattgggaagggggctaggaacagtcttcactcctgccttggtgtgtgggaggaggagaacaccacttcccctctttatttgacactctgggaaagggtggccgccatactgggggacactcaaccaaccaatggagaggggcacactgaggaactgagggccactgccaagagccatgtgagtgagctgtacacatggagtggatcctccagctctggtcaagctttcagatgactgcagctccagccaacagcttgaccaaaatctcaggaaagaccccaagccagaacaccccactaagctgctccctaattactgactcaggaaaactgtgaggtggtaagtgcttagcattttatgccactaagttttggggtaatttattatgcatttttgtatgtatagatacaaatataccaattgatgaagcagacattaccccactttttaaaattggaaaactcaagtttggaaaagtaatttaatgtttaaatggtaaagccagaatccaagttcagggttgtgtgaatccagagactatgctttttgtactttaacatactgaggggaaaataaactagaatagagtccacaaaaataaaaatatacaacatgcgaggagggagaccattaggacaaacacctaatgcatgtggggcttaaaacctagatgatgggttgataggtgcagcaaatcaccatggcacaagtatacctatgtaacaaacctgcacgttctgtacatatatctcagaacttaaagtaaaactttaaaatatatatattatatatataatatatatataatatatatataatatatataatatatatgtatatatacaaaatatatttatatatacataaatatatatatacataaatatatatattatatataatatagttatatatgtatatatttgttatatatgtatatatgtatatacatgttatatatgtatatacatgttatatatgtatatatgtatatacatgttatatatgtatatatgtatatacatgttatatatgtatatatttgttaccatgtattactggtaactgcagagcaaagagcccaaaagttatctttccttgtagatgtgctaaaacaccttagacccaaagcagaaccaatttaccttagacccaaagcagaacctatttacctgtcagactttactctgtattagtgtagcgtaaagagcagagcttcagacctgaaaacatggaaatctggacttgatctcgactctattactcaccaactgagtaacccagggcagatcacgtcaaatactctgagttttagtattgtaaaataagagtaatactcacatgtttcagaggtcttgtgaggattaaattacatctccatactaatctagaacatggttggaactcagggccaagcatttaaacatcagtcagggaaaggaaaggctaaggcttcgactctgtcattagttctaagaaatcaaagatactgattactatgtgctctccccatttgctgatacaaacaggacttttgtttgtagctctaaaaataaggtttaatcatgtcagatactgataaattatctgattaatggcctattttagtgcctcaccttctatggtcttgccttttaataagggactgcttaaccagattttgttggtctaaaagcaggtctgagcgtctaactaagccttcatatcctgaaggagacagagacaatactctgtgcttctctttaccctcttaggggggcacagactaagtggcaagagcaaggggtaggagcaacaaagtaacaaaaagacccttagaagagagttctgatccactcaggaattcattcattctctggccttgttagtcacatattctagtcacactggttaatggctatccctccagtatcctaataaatagcaacacaggggtcccaaaagagtctctgttacccaacagcacctgaaccaatttcattatctgggcagtctgggactctggctgaggacgaatgcatgttccttagtaccctctgctacccaacctgatgcacttagagcaaagggtcagcttctaggccaggctggatgctgtagaaactgtcaactcaggccatggaggcacgtttcagatgatattaaataaagttaacagaacagacttaagaaagtgatcaagatataaggcctctttacagacactgcttatatggtgctctttttttttttctttttagacagagtttcgctctgtcgcccaggctggagtgcagcagcgcgatctcagctcactgcaacctccgcctcccgggttcaagcgattcttctgcctcggcctcctgagtagctgggaccacaggcgtgcaccgccacactcggctaatttttgtattttttagtagagacggggtttcaccaccttggtcaggctggtctggtcttgaactcccgaccttgtgatctgcccgtcttggcctcccaaagtgctgggattacaggctcaagacactgcgcctggccttggtgctcactttttaaagcatgttcataacccagcaacttatcttcaaagaaaatctatccttaaaggtgttgtcaatgactagcctgtttccaagtaaacacagagattctgcatttacggtctatttgcttccttcatgcaacctatcaaatcccaaaaacacctatctttgtggtggacaaaatgaacacttggctgacggcagtgggagagtgaagatttactgcttgccaagagctatgcccaagaaggaatatgagatcagtcaagacagaagcaagaaggatgcaggcttttggctcaacaagcattctccacccacagcagatttatcattggttgtgaacactagagcagtctaggacaggtgcctccttctgcaggtgaaaccactgtgtaagaggtgtagaagtttccttgaagacagtgaccctcaaccctggctgtacaccataatcacctgatgtgccttaatctgatgcccgagccacagttcatatgaattaaatcaaaattgagaaccactgttctatcacctttcctggcaccagtactagaggtcagataccccccacaagacagggagatgagtgggtagaggtgtgggagtcattcaggtgacttttccaagctgagaaactgacaaattgaaattttccaataacactaggaaaatgggcttggaaatcacttcctgcaataaccaacctctcccagcctacatccttctcccgtgctggatgcttcctgccctcaaacatcggactccaagttcttcagttttgagactcggactggctctccttgctcctcaagcgtgcaggcagcctattgtgggaccttgtgaccatgtaagttaatacttaacaaacccccatatatgtatctcctgtaagttctgtccctctaggaaacactaatacacaacctctcatctctgtccacataagggaacctagaccgtcaagagccacacagagcaaaggaaccttaaagatgagctatctcattctacttcatcatgcacttgaggaagctgagacccagagaagggaagtgactggtcagagtcactgtgtttaatggcaggaccacgattagaacacatttctcctaactcttagtcaaggccttttaaatgttacatgctcaacagggcaccatggcttggtgcttaggagcacaggatctagtgctagggtgcctgagtgagaaccctagcttcaccagttaactctgtgacactgggccagttattccctcaagcctcaattttctcaactggaaagtagagataataattgcacttatcccatagagttgtggagactaaaggagagaaaaggaacaaataatgcacctagcacagtgcctgacccacagtaagtgtgcaataatgttagctattcttattcttattaaggaaggtcagggtggcaccctgaagagaggaaaagaaagtgcaggtgtggtttttgggctgaagttaatgttcaaaatgccctagcagcttcatgatattattatgccttcaaagacttctcaagtcacagcaattctgagtcagaagcaggttgctttgacatcagttctcacctaaaggatgtcacaacctctacgcatcctcacctatcacactagctgcctttcctgactgtcagtgaagaaaggacggtggagatgctgtgcatgctgaaagtgccgtgtgaatgtggtctgggtatcactgttcttcacagtgatcttcatccccaccacactgccttagccagtctggattaatatgtcacttgtaatgcaccatgacagaataggaaataggaaggcagggcaaggccacttatagaaatcctaacctttattcttaatagtcaaatatagagaaagctaaggagtagggaggagaaaaacaagatcaatcctggctctctcagcagccaaaagactgaaactcatttgaaatgtccaataaggagggtgagatgaacctagtaagacaacaggctcaacccccttctgggctgggaagtgcctctcacaagaggcagtgacatatttgttgcaaaggattggatgaccaacaaaatcctcttccaaaaacagcaataaaattcaaactccttctttcttgtactaatcaaaatggttaagggataaggatactgcttgggagtcatgagagcaatttttttctttttactttgtaaatgataccgggatttttaatttgcttttttgtgagcactttttaaaaaaaaattttagaaaaggaaggaaggagaagagggaaggagtaaggggcaaaaggttgaaaaattataggggtagaaaatttcaacatctattcattcatgtattctctgtaaggtgtgcactctggtaccacagcctctgaagagtcacaagctgaggacagagatgccctcctcagtattagctgagtggatcccagggaggtggggctttgggctccataaggcctcatcactgctgtcttccctctcctgaccggccctgctccatcttccttctctccatctgtgcagatcacctgccgaatacctgagaaacgtaaccctcaacagtatcttcctgtttatactatgccacattgtgtcctttaaaaaaaaaaaaaaaaaaaagggagagaatttaaaaacctgctccagatacaaggcctcccccactacatgtagatactcctatcctccaaattcctttcttgacggtgatctacaggctttggttaaaaaacatgatcatcttggctctgttcccaggccactgtccctctgtctggttccttcagccttcttttcttttgtagaccacagataactcaagatttggtaatctgacagataatgcccagtccctggctaggctaaatgcttcacttcccacagtgctgagcccaaacaacaccccagaaatgttctgaaagacaggaaaaggcagatgggaaagaaacggctgagagcagaatagatgatgaagaaatatatatgcatggtctgaattacatgccctgttgtgctgattcagttaaagccacacaggaagattctcagagactcctttcagccaagaggccactgatgttctcggaacctctctgttctcaagtacaaccacctcttaactctctattactcagcagatttttcagatcactacagctataaaaagataactgtctcttatccccaccccggagacactaagggaataaaatgagagtttctattaaaatgttttgggaacatacacacatgtactactctaaatgcaaggcagtttttctaccccaaccacaattggaggttagcttagaatatgatcctgggcctatggcaaaccttttaaaacttatacagaaaaagcgaagtgttcatagtctttaccatactcaactatccataactgggaagacaagacattaaacattgaactcttttctatccaggtgttggggggagaaggaaagacagactagaattcttttacaaattttcttgagagataaacacacagtatatctatccaaggtggtccagaatatggtttaagatatttataaaacagaattccctcaaggtctacttctgtaaaaccaagatactaccacctgcctcaccttccacacagggctatttgtacagtgagaatccaacagtgcacagtaagcaccttgaatataacacgtaagttgtaacttgctctgaaaatactcctggcctacagcgtcctattctctgaccctggcaactgctgcttcctacctgctgaagagactatgaagaaagatgcctctagggccactaaaccccaccttcgtaagcagccaaacaaatggaaaaaccattttgatttccactcttgaaagtgctttttagaaatcattaactcaaagtcactaacgattacagttagttaggactaattatctcttaggcttggggagcacaatgaactagacaccccactctttccttccctcacccaccctgcctctctgcacttggactttgtgctgaaggctcagccaggaatgctgcacggcctcaagtctcacagagaggtctcaccacaaatttggctcacctaggctggggaaagccctcactggcttagagaaaatgttttcccacatccttcattttcatgttgaatacatgtggcattcttctaaaatgggtagaaaccaaggtttctccaagaaaagccactaaaaaaatcaaatgctaagttctctggcccagtgtgacctgtaactgtaactcctttaggcattcagaattaaactggcagctggaggaggcagtggccatccctacatcaactcacaagttcagggctgtgtcaccaagacattactttcttttgataacaccatataatggaaactttgaatgtgtctaagcctttcttgaatctgcatttttaaccttccaaatattttaggaagacctgaatacctattatacgggcccttccttctcctaaatttgtccttctagcttccagggataactctatggatttaaagaacaagtctgtgtccttactaagcaaaatgagaaagactgaaaataaaaaatctgacctcaaacagtagccctgccttctcatgataattttgtgagagtagaaaaaacattggattgggggtcaagacctgtgttctagactagctctgccacaaactcactgtgtgacagacagctagaggtttcacttttctgggtctcagatgcttctttgaaataacttaggaaagctgaaatttatgatgttgggtagctccaacttttatagttctgtttgcccatcttggaactttctgctactgcctcatctttcaaaggtttctattaaaattctaatgaattatccacaaacagctgatgtccactctgcacactgtactttcccctcaatcctgctggcccacagaagacctatgtaatcatacttgtaaggcactgatctaagagctttacaaagccttgggccataggagctgccagcattcaaacatttttgacatataaaaacagcaattttatgcagttcaatctattaacttatttaatcctcctaaataacccatgatgtaagtactgctgatatcctcattttaaaaatgaggaaaaggaagcaaagagaagttagtaaaccaccaaggccacacagctagtagatgatggggtttgaatttaaacccaggcagccacgatcctgagcctgtggcctaaccacaacattatattgtgtctcgacatggaaagaagaggagcttgaagactgggactccagaccaaggtactgtcttggaaggagagtgagaggctcacaccacagcctctgctgggttgtacctttcacttcaatggtggcgtttgctttaggagcgctgacaaagtgatatacgcagtggtattcgcctgaatcctcagctctcggcttattgatcctgcagagatgagaagaaaaaccaagtgaggaaactgggaacggtcaaaatataaaacagaaggagaatcaaaggggcaatcagggatcctgctctccgaacccttaatgcaactcacctccttctaactaaaagcaaaaattcctctctgtgcatcctaaaacattaatgtcttgctcttttccaggtgccaagaatacaaagatggaatggcaacatggtccctaaccttagaatgctctggtctactgggagaaacaaaatgcaaaagaagtaatcaaaatagaaggatgtccaaagtactatagtttatattcagatatacaatataaaaccatcacggctgggcacagtggctcacccctgtaatcctagcactttaggaggctgagacaggtggatcacgaggtcaggagttcaagaccagcctggccaagatgctgaaaccccgtctctactaaaactacaaaaattagccgggtgtggtggcacatgcctgtaatcccagctactcgggaggctgaggcaggagaatcacttgaacccaggcagcagaggttgcagtgagccaagatcatgccaacgcactccagcaaaaacaaaaacaaaaatcactaaaaacctcttgttcacctggtggttccagttagataaacaagagaaacaaacaaacaaacaaaaacaaacaaaaagcacaagctttctgagcttctccaaagaccttgttttggtagttctgttcttcctaccttgtcttttaggagcatgcgtttccacaagtctacttgctaacaggacccaggcacagtttaaagaaaaagaaaaaaatctgccatcagagcatcagccacagacatgcagcaaaaagtctggtgataaatcccagggccctacatgatctggcccctgtctatatccctagctccatcccatgccactgtccagatcttctggtctctcttcagtttttcaatgcaccaagcttgttcgcacctcaaaacctccacacaagatgttcctttacagagaatgctcttctcatcactcttagtctacctaactccttttccatcaggtcttggcttacgtgtcagtttattccagccccaatctaaatgtcatccccttccacaacattctctctcacactactctgtgcttcttcacaatacttatcatgtgtgtgattatatatttatgtgattacttgattaatgtccggcttcccaacagaccaagttctatgtggataggcactgtttattcagcatactatcccataccgagtacctagcctggtgcctggaatacggcaggggaatgaataaatgaatgaattactgagtgaacacaaacacagagtgaatatctatgtacagattcagatcaagttaagcagagtgacaggaaggactgtaagaagagtgtatgggtcaggcgtggtggctcacacctgtaatcccagcactttgggaggctgaggtgtgtggactgcttgagcccaggagtttgagatcagcctgggaaacatggcgaaacgctatctctacaagaaataaaaaaattagctgggcatggtggtgcacgtatagtcctagctactcgggaggctacgaggtgggaggatcacttgaacctgggaggtcaaggctgcagtgagccatgatcatgccactgcactccagcctgggtgacagagtaagaccctgttgcgaaaaaaaaagaaaaaaagaaaaagtagtatatatggccagaacagcacttcatttcaatcacacagggtgatcccaaacaagctttcttgcccccgagggtcaactacacatcaactcagtacactctggcctacaagcacatacaccaaacacatgcagaaaggttagtgagtaattacagaaagaagaaaaacatcagcctccagatgagaggataaatagttatatagggctgagttctagctcttttgcttaggggttaaaatatgatacttgtgatggtcaaatctctactgcactatttaatgtctaagaaaaactcctaaactcgaccactctggcctaatgcatttatccatcttatattgctcattccaaaaaggaaacacaggttaagagactatggacgaggagagacatagcctatccccagagctgtctcaagatatccacatggcggcacaatattctgtgagaagcagtcagtgtcttctcaatgtgacaccatgcctcttcttaaatcattatgctcccaattggaaaacagacaagtcagctgctcttatcaacaagtgttccagagtttgaggaaggagcagcagctctttcttcagggcttaaactgaagttctttgagtccaagctctgaagaaagacctgctgttccttcctcaaactcagccctgaacttaagactgaagttcttagacttctaagttctttgagaaatacttgggaagataactcccacacttgagtccatgcctataggctgaaaatctccccacaccattcccttggactagctattaggaagaaattaaagcaaagggaaaacgttccctacaggctgggcagaagcagggttctgaaatcgcctcttcaggctaacttatttggtagcccaaggaactcatcagttgttatttcacgaaatgtagaatccctgaaaaactctagagatacacaacacccttggagagcttcaaataagctgaggggaaaaaagaagcagcattttataaagtcaggctgaaacttcatgaagttaaagctcagcactttgcaggcaatagtacaagacccaagagaaacatgattggatgtctgctatcttaaaggaggtatcataaaaaacaagtctaaggctggacacagtggctcacgcctgtaattccagcacttcgagaggccaaggtggggagactgcttgcactcaggagttcaagaccagcctgggcaacatggcgaaacccagtctctacaaaaaatacaaaaaaaaaaaaaaaaaattacccgggtgtggtggtgtgcacctgtggtcccagctactggggaggatggcttgagcccgggaggcagaggctgcagtgagctgagactgtactactgcactccagcccgggaggcagaacgagaccctgtctcaataaaataaaataacaacaaaaaatcaagtctgtaaaactaatggacagaacaagaaaaaaatgcttttcattccacctaacaactttatttgattaatcctttccaaactatgaggaaaattgctgaggctaaatttctaatttttttttttatcagaagaaactacagtggagataggttaactaccttgccactaagtggatggcatagcagggaaaagaaaaacaattctagaaaaaattctagaaaatcagaagacctggaacctagccttggttctagaacttattaaaatacagtatttggccttaaagcagccaagagtcactcttcaagtcctagtttccttgcttgggaaaaaaaggatccacaaattcatttggatcaactaaataaggggtgtgaaaagatctcaatgctgcaatatcctgcagaatgcccttgctatcactggatacacaggctttcctggtctcacctcagtgctctctttctttgcactgcattaaccttctaagcaggattagctgattcttttccagacagccttcaaccaggaacaaactattctgcaaggtggggtgccatgtgttctagatattccaaaaagcaccaaatatttgggtgctgggtaactctagccagcaaatatccttcttttttcaaaggatatttccaggctaccatcctcaatccagatcattcaagagccctgcatctgctggtccttatcaggttacagtgatgttacacactcctaaaagggaattcacaggaaatctacccagtggaaagatggcttagggagatgtcttgctctacagtcacaaagcagacttcaatctgtttcttcaaacctaacttcaatctgactggattaggtcaagagactacattctaagtgtgactctcctattgactaacattgttaccctgaacaaatcactacttcacagcctcagtttctctatgattatagtgaggggatcatctatgattctccaatctggctgctcattagaatcctttgggaatcttttctagactactgggccttacctgagatactggattggactctcaaagggagaaccaaatatatctcatgtcccttctgcatggcgcaactatggattatgaatgtcaagtaagctcagccacactccctcccaccttcccaggagctgcccaccactctcacctgtactccatgttgctggcattcttacgagtggcactcagttccaccccattctttgtccagtagctgtatgtaagggtgtgagagctggaggtgaggttacactgcagggtgacagggagaacagggctgtctcgaataatgacctcttcactggtgacaatccttggctctgtaataagagtgcacaatgatagggggcaatagccttccatcctctgtagccctggcctgagagttggacggggtaggagggggaaactagaaaaagagggagggcagacaggaccacatgaggaatttcactttaccactttggaggaagtcaagaaaggaaaaacaatgattataagcaaatgaccactagcgcagacaacagcctgaagaccagttggcctagacgtgaaagaatgggagtattacgggtgcttgtactggtaataatccacttacgtttttgaataccacctttttataagaaccaccaaacaattcggcttcaattagacaaccaggctccaccttgccattctgaagacaaaggccatatcatttatatacctattataataaactccctattgtaccactgggccttggaacagtaataattacataatacatgtatagctttccccacatttaaatgttaaacctatggcaaaccataggccattatttatgcagaaaaagacattgtggattctaaaaagcaaacttcctattggaagtcacttgcattttccaaattttgtggaggcaaaattcttgagaaagcatcatcagttcctcctctccagccatacctattcccaaaacaagttgttgttttcagaattgcactttaaaacacattccattctgagaaaatataactagagtgcaatattgtgttggtattatgggctcccagaattttagaaaggcccttagagttcattgaatcccactctttttttaagagctggaaaagtgaaatgatttgtgcaaggccgtaagtattactaatggcaaagctgggcctagaagacatatctgactgaattctctatccttgccccccatccccaagaccacccccaccaccttgtgtcctgggcaaggtatatatacttcaccttctgattctattctgcgcttagataacctgggatcactagcttatctacaaaaataacctacttgagtcaaatattataatacattgaacaaaaatgtttaaaatcactctatattattcctggaagcttcatctttaaagcactttgaaatctatcactgtattaaagtcaagacatttctatgtttgttgtcttttgttaatgtgctttgtctttattatttccccaggcttagttttctctacttttgatcaaacatttccaggtgaagtctacactaaccatcttttcccaaccacaataagaggtatttgctgtttgtttgttttccaattctctctcagaaacccttgactgacttcccatttccctgtgtctagtcacttcctatctacagctttgcagcagctcccctcaccattttatacagtattgtgctgagccttaacgtgaggaaagaactctctccctccatgggaactaagttgcttgctgttcagggagggggaaagcatggggaagtcgtgggatacttgggaaatgtaatgtcttaaggacctcctaaccgatgtaacatttctgacttgtagagttaatgtctttgaagaaacttgtaataatgcaaaaccttaagtttgctcaattaacaaattagttctattttccaactctggcaaaaggataacggttatcttccattcagcactggtccttatcagtaacatcaaacagggtctctatgtacagataatggaggcatagcagccactaagacagaagcagatgcatgtaaacacgttagcgcagtggtgtcccatggtttccaagacacactggacagaagccaaatccctgggccttaagaagtcgagcagaacggctgcaaaccctgcaatggaaggcgcacacacaccatcagcagaaagcatcacaattccaagaaaaatcaaaaccaagcaaaaacaaaagagaaaaagatagaaccagtactccacagaagagaaattaaaaaaatataaaggcaacattaaaacccaaacacacttttaggtttttacttaatttttattatccaatttcattttctgtcccacttgggactctcgttctgggtattcctctcagactgcactgagaaagggtaaactctgagaatgaggccaagagcttccagatgtttaaatacaaggaggccaaagtaaatgctactcttacctgtggcgatgcaaatgaccactgcagctcagggagattaagaagttgatgaaagcaacctggtagactttctgccaagtattctttgaaggcaaaggaaagcactttttcccttaagtgttaaagatccaggagagagtcactgggagcaagtggataatttaaataggtttaaatatgattctgcaccataggagggttgtggggtagggtaacctgcctcctgtgattgctgtatatgaaaaacagtgctacaccaagttccttggccatggtgcctcaactgcattctgcaccaggatgaaggtggggcttttatttttgtggccaagcgctgcccaaagtccaagagagatgaacatttaggagaagttcaaatgtgtttacctgccactgatgtctatttaaaagcagtggataggagacccttaccccagccatcatgcatatataaagaacatgctatggccagagagatacctaaaaactgggcacacttctcttcttgccttacatactcaatgagctttggggaaagtactaccaggaggtcattcttagatagaacacctgatgtccccatagagcaatgtcttttgggacgctgagatcataaaacagtccaattagagttggatccagggtgttttaaaaaaaaaaaaaaaaaagcagcagcagcagcaacaacctcctggctctccaaaacagctaacttgggttaactgactgatggggaagtctgaagagagtctagccaggatttggatttgattcaaccacatgcagacaattctaagtaaactggggaatgctatgtattctcgggattggtaggtaggtaccccaatgcctcatctttttctagccccttggcatggccattctagctatgagtcaggctcttggaagtataagtgcaaatgcccagcccagtccatacctataaacttccacagacctttgtggccatgtaggtaattctgcttttataaggaaaggagcaagggggcaggagaaggaggcgtgcagggtaaaaatattgttaaaaaaaaaatcactgggttaatgttccccattttcacatagacaaggttttcttttcctctttccagaagcaggttctttgattcaacagtgccaactgcagcagcctctcctaccactgccctacaaaggactctttttttacccataggatcttcaagtggctacaaagaacagacactaatttgctattttccatctaagtatatagactcaaggcccatgtcttactactttatgttattaccaaattcctcatcaaagtaagattttactattcttactttctctagatcaatcagctctttaagctggaactggctatagatctctcattgtgtcctcaaagagaaggtgaaaaacccagaggatctttccaaaagtgaatgtcccctcaattataaccaggtttgatgtggggccagaactcttcttggccaggaacgttggttctgtggtggcttctccctctctctgcttctcaacataaggtagcaagtcactttcaagaaagagagagaagtggccacaaaagtcccggtgtcatatgtctcacgcatacctgctacaaggagaggattctgagccagctggtcagctcaccccatcactatgagaaaccaggttggaagttagtttcctcttttttcaagacacaaagaaaaggccagtgtgagtggtccccacactatgtctggagttcccatgctctgggataaggtacactgtgccaacagctactcatcagagtcaaaccgtgaacaggaatcaactgcaactctgacttccaaacagtgtgatgggctaaaaaaataataatttgcagcttagtgtcacctggctcctaacagcaaaacataagaaggaagtcccaggctgctgcttttaaagaggagactaattagcaggcccagtgaggagtacactgctgcagtagagggctgttatcagagaagcacatgccacggttttagaaaagaaaaagagctggaactatgaaaatatccaagcttacatgccacccaacaaccaaaacacaccaccacactgcacccatggcaacattcccatcacaacaagatgacaccaagtcacagttaaaggaagaggctgggcagacacaaacttaaaaccatagaggtgaaggcagctacttagagagcttcaaacagaagaacagaagaaataaaaagtagttagactggggagagaaacaaaaatagaaaggcaccagagaagaaatcagcaaaagtatagcaggaaacctactacaaaatcaaaggggagggaaaaccatttcaacactaccctccttggactgcctggttttatgagttttaatttaagcttcccagttctccctccccaactcttcccaacacagatgattttggacagtcacggatttcctcaagttctttgttcctgagaagaaagacacagagaagggttgggggataagggaggcagagagaacggcaaagaaaagaagaaaaaaagttgccacagatgttttcatacactacaaccagaagggtcatgggattgaaaaaaaaacgaagacaaggggtggggtgagtgatcatactggggaagagggaaaggatgcagaagggaagggtcattgggccacctctaatgactacagtactactactgtagggtgctggactcactctgaaggacgcttatggtggcctgggctcgaatccatgttatggaggggttttgcctcaagtcattcctcttggggtcgttgctggccctgcactcgtaagtcccagagtcctccaaggtgagccgggttattctcagcacactcacgccgtttgacccgtaggcggtgtttacggtgacacggcgcttccgagcaccgtcccacagctgtctgaaagactctgcccggttgacttctgcgtaccaccactggatctctggcgtggggctcccgaccacgtcacagtacagctcaaaggcgtcccccgtgagcttagtttctgacatgggcgacttgacaaacccagctagagggagggggagcaggaatgcagtgacaggccaatcagaaaaaaaaaaaagaatcaacaggtgttaatagtaatttaaagaaaagaaaagaaaaaagcaaatgagttgcaaagaacaaaaaaggattcatttttaaactataaagagacagtacagcaattcatacaagcttttagaagaagaaccacaccctgggaagcttatgaagcaaaggcaggctaattacaagctggggcagcccaggtgctggccaggcagaagcaagcccactggaaagcattttagcaatgggcccagctggtaggaatgagaaagcctcaggtcttgggaagagcctctttccttagaacacaaaccatttattacctttttaaactcaggcaagtgatgaaagataaccagaagaggcagtagttttatatgccaaatcaggatctctcttttggatgggcaaacgctttgttagaaatgcagtgtcttttgcaagcctcaacaagaagtattaaatgacctactggtgccttctcttgggattcagagttcaaatttcaactgaaagagtagcaaatttctctctcacacaggattctatcctgggttcgattagactttctccacctcctattcttccctgggcctatggcaaacaaacaacccagttgtttagcgttaggcagcctcttcctgaatgcagaccctcaggagaacaagacagtctgtacttcacaccacagtgagatattaatactttgtgggtcagctcagaagtgggaccaacaataccagcaacccaactcactgccagctaatggagggactgtgccctccataaccccatagatccattacctagaaaaatctgaaaagctatggtatttgacaggctccatacagttgaattgcctggcttctagaagccagctcagaagaatgagaaatgtaccctgatgaattaaactaaacactagggtgaaagccaggcctcaaccaacactcttaggaactgcccaggaactaaagttgatgcctacctctaattgcccataatttgcttgaggttacacttccataagacaaggtggaaatggcagaaagagttaaaaaaaaaaaaaatccaggcttagtttaaaaacttggagttaggtccataggaaacaaaatcagagtgcaagcatactctctcttacccttccaccccacctagggttcattcagcatttctactgattcagacagtatccgaaggtataaagagagacactaaaagagggcattctgattggcttggaaacgtcccctgggaggcctgctgcataagccaagccagcccctgtgcagtaagcagggagtgaggtcaggatctgccaacatcaaattaagaacattccagaggaaaggatgaaataaatggaactgttttcctacagtccagaagccaaggatgttaacagggctagctgaaaatggaggttactaagtggaaaaattcctgtttacatccatagcagtatttgcctttggtgataaccccacaccatggactaagaacattaatggaggtactatacttactcaagtagaggccaagacctccaaattcatactagtctttcaattcctgacattttcagactctggggagcacaggaatgcagtgattaacaggcttagactaaacgttctgcctttaatatgccattttaaactacctcttcagatccagcatgcattccttgtaaggaaatatctaccagaggccccaagaagcccaacagatgtcattctcagatgcaggagaagctttagaattacagaaaggagcccccaagcccctgcatgaagagctgagctcactgcccaataaagtggtatccaaggagccatgtctcggtctcacaaactaccacctgcccacctgtcaaagtcaatgccagctaatataaacaaagaagtaaaggagggccgggcgtgatggttcacacctgtaattccagcactttgggaggctgaggcgggaggatcatgaggtcaggagttcaagaccagcctggccagtatggtgaaaccccgtctctactataaacacaaaaattagttgggcatggtggtgctcacctgtagtcccaggtactcgggaggctgagacagaagaatcacttgaacccaggaggcggaggttgcagtgagccaagatcgtgccactgtactctgccctgggcgacagagcgagactccgtcaaaaaaaaaaaaagaaagaaagaaagaaagaaaaggaagggagggagggaggggaagtaaaggaagttggttttatttattttactactggctcaatcaccagagaaaactggatatcagtaaatccctgaaatgcagtaaaagtattattctgttttaatcatattcttgaccataagtggtaatcacaaatggtcttatcacattatctgtgaacttggggagttacagcctctcaaatgcggtaattatgtactcgattatgccctagaactgttagtggatttcttttgtactttttcccttcttctgtattgtacttcaaagcagccttagacttaagcctgtttatcaatctgttgacaatgctaatgtaaaaaagatgcctgaaagtatcctttcaccaagaatccatccaattccactgtaaccccaagtcctaataacacacaagtcacaggtagctgagaaacagtctgactatgattcccactgcacacaactgggcgagtcactcagccagatcatgccaccctgggcaagacttcctgctaagagtaaggaatgctgatctgagtcagttcaattttctacctgtatcaaggaaaatgggaccaagacaaaaatgttctttgcattagtaaattataggatgtatatttaaatgaacttttaaaacacaagataaaaaaccctttaaaatgccaacaatggtctttgaaggccattattgttattaccattattagacatatagagtaacagtgacattttctaagtatgcattatatgtttaggcaatgtgctaagcactttattcattatcatattcaaaattcatttattcattatgataagtgccattataatttttcttaaagatgtggaaactaacgtccaaaaaagttaaatattttgcccacggtcacaagctaataacaaagagtctggcctggaatccaaagtgaaagcatggtctcttaacacttaccacaactgtggtcaatgtgtctcactggcctgaaaaggtttttgtagttacttaagttaaagatatgctttgtcaccacttagtttaattaataaattaattaataataattcctggccacaaaaagccaggaacctttgaccaattgtgcaacatactatgatcactaactccataaaattataatcttactagagaatggagatagagaagcactgggtcaaagagttcttaaagcaactggggggagggtgaacagtgtgaaaagataagatgattctgaggcaagactgcctctagttctgatgattccaatgccctgctctggagaaggctggcttcagagaaggaaggaatttacaagacactggaaaaatttctctgatgctgtagtcaggagccaaattaataaagggcagcacctgaaagttttataaaactccgcagtttgcaaagagcttccacatacatcacatctcatttcattcgcacagttccacaaggttcatacatagggcaggtgcggagacaggtttatgacttgcccaaaatcacttaggcagttaatcctgagtggggctgggactagaatgcaggtcttagcttagtctagggttctttccaataaactgtgctgcctctaaacaaactaaggaattccttgatagctgaacactcatcaaaaaccatgaaaagagatctattccccctccaaacagcatggaaaagaaagaaaagaaaaagaaaaagagaaaagagaaaagaaccctctttacaaagtactgtgaaatcacaattagcaagggaaagttattagcaaccatccaccttattatccatccaaaattagcttcaattcaggaaaagaactggctctcagcagcagcagcaggaggttcagagcctgactcactgccctgcctttcattactaagggctttcaaacaaatatgtaccttcaacaagaaagcacacactgcctaaagttgggaggccaacagaagcatctgtttgctctctaggtcaagggtcatccaatattttggaaaaaccctaaattttgtaagacaacctcctaccccaccctcttccccaccatcgtctccacccactatcttaagtgactgggcccagatctgcaagagttttgggaaagtattaatatcagtgcattcagagcaacagtgataaagagggaaactgaacagtggttactggctttgagggaggaagagactagaagctgatgctggagggggtagcaggcagagcattaaaaatggaggcagcaaacccaagagaagcgtaatgtaaaattgcataactggggatgggggatgggaggcaaagatgacagctgggactagcagccggagaaaaggaggagcttgctggcaggaaaaactggatgtgtggatatgtagcagagggtgagaagaaaaaggaaacacagaagagcaagttgagcccaatcccaggaaaactgctttcatatatgccctaaggaagtaaaaaaagctagcctagccctatataggagagactatcatgatttttcacatttacctccagggcaacccacagaacaagaaatcagactaactttctctctccctcaactgactactgccaaggccaggcctttaagtcttgcctgcttttgtcacctcttttaaaaacagctgttcccttcaaaccccctctacctctaattccctgtggctggctcatgctgttctctccttcgttcctcgcaataaagagaaaatgacagccaagatcataagagcgtttctctcctctgtctctctcacacacacacaaattcaaatcgtctacctcaaaataaagactgagcaagacccactgacatctaaacgtgaatacaggaactatgagtatttcaaatgtctaaaggacccttaactgctgtgaggctgtcacagacttgagcctacacaaactactgtagagcctgcctatccttcctgttaatcaggaaacagatcattcatcactattccttaacaccaaaggcaggtcagaagtctatatgcactcattctgtgtgtactgaccaagggtaaggcaggcttgaagtcctgggagcagaggaaatggggtaacctcattctctgcagcaggaagaggtaccacagattagtctcatctctaggtagagatggcagcaattacaaaacattttccaaattcaaacctgctccttccacaggtaccttgatcaggcagatatgacaaaagtttggaaattaagatcatccctatcactagcttctaaaccagggtccaccctttattctgaaattataccattcaaaatgaccaaaggcatctataccagccagccttctgctttggaaaaataggggaatctagttcatgccaagagaaactacatagtttagtgaccaaatgcagcaaactctaaaatcagttgtctggattcacataaggctctgtcactaactgtatgactgtaagcaagtgacctaacctctctgagcttcatctccctaatctgtaaaacgggactaataatagcagctacctcacagggttattgtgaggattatatgagataacatagcttaaaacagtacctgacacatagtaagcactcaataatgttagctattattatatgtctccatagaaataagtgctaaacaggccacgggcagcagcctgcagcactgctccacaacaggctgggaagcagaacttcacatccaaaatgagcttaacttaaaatccaagttcttcaagaaacaacaaaaaactaaccttaaccttccaaataaaatgagaaccagaacggaaatgttaactgcagaagggaatgaaaaagaagggaattcttcattccttcctatctttagagcaaactggaatgaacaaagtgataatagcagacacatgtatgtggactcaaggaattagcaagtgttttcagagttataaaccattaaatctaagatattatgaataatctggaaagtccaagaataataagaataaagagaggcagtacaaattctccttttcaaaaaaaattcttttaaagtagaaaataatcctatcaattataaatcaggctgcttaacaatatttgggaagatactggatattgaacaggccaaactgttaatttacaaaatataagatgtagttatggaatctgagatcatgtcacattagcttaatttcagcctaagaaaaggtgtcaggttttgagtcagcacctccacaacacaaattctcttaactttaagcagtttcttcaaatgggaatgatgccactttctttatagggtagttgtgaaaatcatgttacattatgtgtaagagttctgtaaactactctatgcaaatgttaagttactttaggacagacaagaaataagcatttggtatgacggatctccctcaacaaaaactttcattcagtcctgttgccaattcctactgacaagctaaacaagcatgatctacctagatctacaggtttaaaaaaaagtcaatgacaaaaaagaaaaaaatttaaaagtatgatttaaaaaaaaacatgggccgctcacactcataatctcagcactttgggaggccaaggtggtctgatcgctcgagtccaagagctcgagaccggcctgggtaacacggcaaaaaactgtctcttcaaaaaattagccaggtgtggtggtgcaagtctatgattccagctactcaggaggctgaggcaggagaatcacctgagtccaggaagttgaggctgcagcatgctggggtcacaacattgcactccagcctgaacgacagaggagaccctgtctcaacaaagaaagaaaacaaaaattatgggaatctctcaactcagaaaaatataaccaaagttttgcatatttcaggggtcttccagaccctgagtctagattgtactactgttagatgagtgaacagttaagggtctattaagatgagagctcaccttatagggaaatgagccatggtttaaaaaacttgggatggatttttccatttcttcaacctcagtttcctcatctgaaaaatggggacaatgattcctatcttcttcataaggtcatggcaagattcacatgaacaatgtacataaaattactttgtaacctgtaaagctataaatgtaataacatgtcagttttatgcaagcattctactctattaggtaaagaatgatctaaggccaggcgcagtggctcatgcctgtaatcccaacactttgggaggctgaggtgggaggactgcaccagtctggacaacatggtgaaatcctgtctctaccaaaaatagctgagcatggtggtatgcacctctagtcccagctacttggaaggctgaggtaagaggatcaattgagcctgagaggttgaggctgcagtgagctatgatcattccactgcactccagcctggtgacagagtagagaccctgtctcaaggggggggggggaaaagaatgatctaaactagtcctgagtgttctattaacatacctcaaaagcagtgtggaagaaactgggggcagggctcacacacatccatgaaggagggggatgtctactggactgactgtttccaaatctttccattttccaaaagaaaaaagcactgcaaaccactgatccagaaaattaacatgtttcaaatagaaagtgacattaaatgaggtaaggctgccagaaattaataaaaatgatttagaataaattctggttaaaaaaaaaaaatcttacaaaaatagaacctgacatcagacctgagaaacagaaagaattggaaaatgtaggtcgggtgcggtggctcatgcctgtaatcccagcactttgggaggccgaggcgggcagatcacctgaggtcaggagtttgagaccaacctgaacgacatgaagaaaactcgtctctactaaaaatacaaaactaggtgggcatggtggcgcatgcctgtaatcccagctactcgggaggctgaggcaggagaatgaggtgaacccaggaggggaggttgcggtgagctgagatcgcaccactgcactccagcctgggcaacaagagcgaaactcacctcaaaaaaaaaaaaaaagaattggaaaatgttaaaagcaaagagaagaatcagctcacaattgaacccctcttgcattccttttgtacgtctgtcttccagggttccttcctatgatcctgaatatcctcacatggactcttaacagattgaaagctctgcctgtatgttacttatcagaaaatactatggccatcatgcggtggctcacgcctgtaataccacctacttgggaggctgacgcacaagaatcgcttgaatgcaggaggtggaggttgcagtgagccaggatcacaccactgcactccaacctgggtgacaaagcaaactacttctcaaaaaaaataaaaagaaaatgctagccacttgcaggcttttacagtactcaggtaaacagcttcattatcaaagacactgctggagactaacaatgtttctccttcaccccagggaggaaaaaggcatttaatttactcttgagcagtcagatccaagaaagtgtggccaaatacaataaatcagggcccattttgactttgacatcaaaatgaccatgacttttttaaaactaaggatgtgtctgtccaaggagaaaaatgcagcagccacaaactattgtcaagctagtattttcaggggaattttaggtaattcacttcccaacttcacaaatagtacttaagctgctggtccctaagagaaaaagctggttttgctagccattaaaaaccaggaatgtctcatgcaggggaaacagaaaaatgcacacaaataagctatatcttaaagagagttattaatgaaaggtctggttcaaatatgtaagtgaaacccttacatatttaagcaaatgctcataaaagctctcttatcccaagagattgtcaaaagtagctatgggcagatctagaactacatccaaaatggagctttgaggccaaaaacaattttaattaattaaaagaaaaataataccagttacaaaacatttaaagagtgtacttcaactgactctccagttagcattaaagccaaaatgaaaacaatatactagaaagctttaatacttcaattcgacaaagattctttgcttgaccaatatgtaggcttctgaaccttctcctaggcccatctgtgaacttccttgtaaaattcagttttagcaaagaaccttgctaagtcagtttagcaagaacccccatctttgatcatcctcagtatcagatcaggttcttcagcctccaccattccctagctgaggtctgatcaacctggcctatcctcagtgagaatgtttaggttggcttagccaaatcctccttacccctaatgtttcctcttagtaattttccatccactgacccccacctgcctatgctgtattcagagctgagcccatctctctccccagtgcagaatctcactgcagtggtctggtccctacatctatcaccatgttctaaataaagcctttcttaccatgctttaacacgttatcatttttttttctttagcaagttgaataaaccattctcaaaagccataggtaattactgctcaaaagctaatctttgccaaactttttctgtgaaatgcacctgtctataaattcagcgtaacttctgataacaagcttactttctgtctctgacaacacagtaacaatcaggacttaaatgttaagataccaaaattcatctcattcttccatcatcatatatcgcatgaatatgacaatgaacacaagcagtccaagctgatagtctaagtataatctagaagacattttaactgaaagaggtagtaagctacttctccccacctttttttaaacagccattctcagaaaccacagagtcaaaaactctgaccagagggaaattcaagttttgaatcacatctcaggatgttaggtaaccgtagtcctagtcttcccagctgatgaactattaatatttccaaagcataaatagcttatagcagaaatcacactgagaactttgtcattacatacaaaaggcaaagctttccttagatgacaaaattctaaagcagtaattcttaaattttaccatgcagcagaatcatttggagggcctgttagaacacagactgaggcctgagactgcacttacaagttctcaggtgatgcccgtgctgctgctccagggaccatactctgacaatatcttggagaatctgaaactgtgcaaatattgtgcaaattttgagcttgtttaaatggaaggaaaacaaaggcataagagccacacagatgtttctgaaatcatataaagattctcccaacagctgggtctgtgatccatggccaaaagaagtagagtagcaaaaacagttgctaaaaaaactgtgtcactatgatttcaaaacaatgacttttatcttggatttgttcagttttccagtgtatacactgacaggatgcttcaatttaccatttattgaggtcctgtttaccaaggactgtgcacagggataaactttgttcctaaacagatttcaaccttgcaagacacaagacagaataatcaaaatacaataccactgacaacagcacttctatgacaggtatgtacaacaggaacatatataaaaaataattttgttggactaacgtatacctagaaagctcatgcattgaaatctaaatctagccttgtcagttgcggggagagatggtcttgttctaggcaagaggaaacaccatgagcacagtattacaattagtaggaatgagttctagataaaggtgaaaaaattcaacattttttgagtgctattatatgtcaagcacctattaagtgctcatgctattcagaaaaatatcctcaagacctcacaatatagggagaatgacaggtatcctgtaagctatgaagagcatattgggcttctttccatagaacaaggggtatgactgctctgactggtggcagtacaatggctgtcagaaataaggaagtcaacaaggagttaagaagctccttcaataatccaaatgaaaaatagtctgaactaattaagagtggctgtgggaatggtgagaaggtaacagacatgagaaatgtttacaagatagaatcaaatgaacttattgacgtggggtgggcagtgatactataactgtaataagggaaagcaggctgagctggctttacagacatctggagatatccaaatgtagttaaaaataaggatctgatatgcaggagagaggtggaggctggaaatatgcacttgggaatcatcagcttatggacgttgaagccatgggaggagatgagctgactcagggaggatgaaaaagaaactgagaatggaactttctacataattatacttctttccaaatgattcaccactgaatgcaatgcactttcactaggataaaataccccaagttaggaactaattcccttcccatatctagacaacacttttaataatgtcaagtaaatattttattactttgcttcagaagacttaaaactccatgtcaatgactcagatataaggcacagtatccataccagaaggtctcaaagcagcattagacttcgcttgagtagagtgtgtaatgctattagcctttacaaagaatcctggccgggcgcagtggctcacgcctgtaatcccagcgctttgggaggccaaggcaggtggatcacctgaggtggagttcaagagcagcctggccaacatggtgaaaccccgtctctactaaaaaatacaaaaacttagctgggcgtggtggtgggggcctgtaatcccagctactcgggtggctgaggcaggagaatcgcttgaacccaggagatggaggttgcagtgagccgagacggcgccattgtactccagcctgggtgacagagcgaaactccgtccctgaaaacaaacaaacaaacaaaaaacacacacaaagaatccttaccttctgagaaaaacagtatccatatggttccaaagattacctttggaaatgcttttttccccttacttttttatatgacacataaaaattatatttatatgacacataataagtatatatatttatgggatacatagtgaagtttcaatatatatacaatgtgtaatgatcagattggggtaattagcatatccatcatctcagacatttatcatctgtgtcgtgaacactcagtattttctattttagcaacatgaaagtatgtattactgttatagtaatcctacttctagtattttctagctataaaacactacaacttattcctcctatctagctttaattttgtgtccttaaacaaatccctccctattcctttcttccctcaccttcctgttctactttttacttttttttttctttttttagagacagggtctcgctcttgtcacccaggctggagtgcagtggcatgatcatagctcactgtaacctcgaactccttggttcaagcaatcctcccacctcagcctctagagtagctaggactacaggtgtgtgccaccccacccagctaagttttttagttttttgtagagatgagggtcttgctacgttttttgtacagtatgctagtctcaaactactggcctcaagtggtcttcctgccttgacctcccaaagtactgggattacaggcatgagccactgtactggcctactttttacttctatgagatcaacttttttttaagcttctgcatatgagtgagaacatgcagtgtttaaattaccattcctgggttatttcacttaacatggaatgctttctgtggagaaaaagctaacgcataatcccaaccaaattttctcaacttttaaaaaggaaaacaagcggaatctcagcctaaagcccaaagctaaaccaactcccactctgcagtaaagagtactgaaaagaaacaaagccaatatgccacggaccagtgattctagagaaaatattaacagaaatagtaacccctattttagactgtgataaaagttcatgaaatattacaatgtttatgccccttttcctacccttctggtcccctccagtatttctgtaaagattaaacaaatatgattttggaaaataaggatatgatagtgatacacaggcaactgaacaagagactcttcacttccacaatggcatgaaatgggaacattttcccccctctaggccccagtggtttctcaatttaaaaaaaattgaggatgctcagcagaactttactgagtcttattttgaatcttgaaaaatgagacaaatttgactccgttacatatggaccatatggacaatgtgctgaaactgcaaacattcccactacttaagttgtgatagtagcaaaaattatttatacagttacactgagccagagtccaaagaatatttgatatttggtatgacacagtttatgaagatcctgtatttgtccctgaattctcaacaactcatataattattgttcattcaggaagacaatcattcttaaagtaatacgcaatttcactcccattaaatgggaatttatcacgtattcaactcactgttaaataattaaaagttcccacttgtggaatttagtatgccaatctcgaaacagactatcaagaacattttcttaaaattaaatatgctcccaaacagtaaaatactattcaatgcaaaaacaaaacaaaacaaaacaaaaacaaaacaaactctcaagccatgaaaagccaaggagagaccttaaatgcatattactaagtgaaataagccaatctgaaaagggtacacagtatgattccaactacatatatgacattctgaaaaaggcaaaactatagagacaataaaaagatcagtggtcccaggagataagaaggaaggagggatgaagaggtagtacacaggggatttttaggacagtgaaactatctgtataatactctaatgattagcgtatgtaattatatatttctcaaaactcatagtatgcacaacatcaagaatgaaccctaaactcaaagtcctaaactgtgatctttgagtgatgatgtgtcagtgtaggttcatcaactgtaacaaatgtaccactctggtgggaatgtgatagtgggggctgtatgtgtgtggggacagggggtacatgggaactctctgtacttcctgctcaattttgctgtgaacctaaaattgctctaaaaatgcagtcgatttttttaaattaaaagtatcaactgaaaaatacttataatcatgtactgaggtttatttgcacttgacactgagcatatctgattggaattttttaaatgatacataaatgcaaagctacttttgagcaagcaaaaataacttctgctcggacaagctagtaatggtcacctatcttgtgtttctgatgcaagcacagaaaacatgggacaggttgggcctagtggctcatgcttgtaatcccaacacgggaaggccaaggcaggaggatcgcttgagcccaggagttcaagaccagcctgggtaacatagggagaccctgtgtcttacaaaaatgtgaagaattagccaggcatggtggtatgtacctatagtcccagctactcaagaggctaaggtggaggaacacctggacccaggaggtcgaagctgcaataaaccgtgatcacaccactgcactctaacctaggcccacagagcgagatcctgtctccaaaaaaaaaaaaaaaaaggaagaaaagaaaacatgggactcttaaaccttaagatctatcagactggccaggcgcagtggctcatgcctataatcccagcactttgggaggccgaggtgggcggatcacgaggtcaggagattgagaccatcctggctaacatggtgaaaccccgcctctactaaaaaaaatacaaaaaattagccgggcgtggtggccagtgcctgtagtctcagctacgtgggaggctgaggcaggacaatggcgtgaacccgggaggcggagcttgcagtgagcagagatgcgccactgcactccagcctgggcgacagagccagactctgtctcaaaaataaataaataaataaacaaatctatcagacttcaactaggctatcttaattaatgctctcctaactccattaaacagaaatctcccatcataaggaaaagaatgtcataggaggaaatctcctaagcctttatcacgttaaatgcccaggagaataaattacacttatgggtaaggtaaccatataatttgtcatctaaacctgaatccttctgagagtgaaaggggtgctgttaataattctgacagggcaacaggcacaaactgagaattatgattactcaacttacagggaacctggaggatgtattatgtaagattaagcaattagagtggagatatcccagaataaaattctaggtcaataaacttccaattctaaatacagtatatttgtgatttaaaaaccttccccaaaacctggagcaataattttccaagaatccctttgattgttaaatatctgagtctcagattcaaatgtatcaagtcctccaaagcacctccaaaattcctattttatttttatctattaaaattataaatcttccaccttattcttctacattcaatattaattggtaactataccacccttagctaatttttccattaactagaacctattgtcttagaataaagtacacaattcaaggccctactgctccaaaagaaaatgcctctcttgattttaaatggtagtatacaaagatcaatgaacagtaatatttacaaaaggtagttctccacttagtaatttcagattatcatatttagtaaaatcataaactctggttaaaaaaaaacaggccaagattgtgtcagctagcaatgatgctctagaatttattaccatatactctctaatagtgtctcagaaatgaatacgaagctacgcggtaacaaaatgctggacatatcttttttttttgagacagagtctcgctctgtcgcccaggatggggtgcagtggcacaatctcagctcactgcaacctctgcctcctggattcaagcgattctcctgcctcagcctcccaagtaactgggattacaggcgcccaccaccatgcctggctaatttttgtgtttttagtagagacagggtttcaccatgttggccaggctggtctcgaactcttgaccttgagtgatctgcctgcctcagcctcccaaagtgcggggattacaggtgtgagccaccgtgcctggcctggacataccaatttaaattgtaactttttgaaaagtatatttaagccaggtgtggtggctcacgcctataatcccagaactttgggaggctggcgcaggtagatcacttgagcttaggaactcaagatcagccaaggtaaccagacaaaacctcatctctacaaaaaatacaaaaaaaaaaaaaaaagctgggcatggtggtccacacctgtagtactagctacttgggaggctaaggtgggaggatcatttgagcctcggaggtggaggctgcagtgagctgagactgtgccactgcacttcagcctaggcaacagaagtagaccctgtcttaaaaaaaaaatgcatatttatagaaatcattccatttaataaatacatacacatatattaaaacctgaaacctcagttcccttgtgtatataaccagaagactggaatggacaatttctaaggtcctttcagctttaatattcagcaaatctatgtatttgtagatgtaattgatgaattaattcaaatgccatattctatgaatccatgaagatgcacaaggtaagaagaaagaatatatgttaacagattataaattatttggaaaccaggatatgtctctaattttgtttccccacagtgccttgctgcacacattatactcaatatttgttaaaagaaaggtgaggaataagattcttattaatgaaggattaagaaaaaaatcctttcattaaattgcaacctattaaaaacttaaaatgtactagtcatgttaataaatgtataataaatgaaaccatctttctttgattagtggagtttttcatagaaaggtagccatcagagccatctttcttaatatcaacagaatcatattaatacattctaaaagactagactttgttatatttgaatttaccacagataccttagaagttaccttttgtttaaaaaaatcaaatccctaatgtcagtttgttttctaacaagcaagggaataaatttgagtttaaaatagatttcttatttgagtttttactttacagttaggtttcaacttaaccactgttttccaagttaggtagtgatgctgctcatcactaggtctaaaagagatggatgttcacagtttctgtgaaactcctagcatcaaaaacaaacagcttaacaatctttttttttttttttttaaagataatcttgaagaaaaccatggtgggccagggatggacagggaataggacactttttaactattcttaaaaaataaaaaagaacatttcaaaaagattactgagcacataactaatgtctctgaaaggaaattcattataacagcagctagcctttattgatcatttgtgttagacataacgcaaagtatatcataatttaatttgctacataaagatacagtctacctcttaaggttgcttttgccattctacacagtacagaggaatgatgcacaccttggcagtatacttccagagcttgcaatcactacactatactgcctcactgacagcaatgcttttactataaacaatcagaactaaacaatatcctatatacattatttaatccaaacacattttatcttagaaagactgtacacagtgagttccacttctctgtcatcaaggttaacagttcaggcctttatcactacactttcatccccgatctgaattacctatacaaaaagtctatgtgggcctatgagtttaaaaggcatttggcattactaacaaagaccgatttttaaaagctgatgttcctaactagtaaactggaacttggcagtaggtttccagttcttactgacagatctccaagatggttactaaaatgatacgcccctaagattttcttcccaccaagaagagatgaaaatagcaggttcatcctctttccaaccagagacttaacagcacatttctgcactctatcatgtacatatacctggatttcaaaactcgggtaagtgacaggtagctctttcttccccagaggttggcaagccttgtaataaaaattattttactgaatccattttgcatagggtaattatatttgtgctattttatacattctatcttaaatgggtcatcttttctgttggtcttatttcaacaatggacatatatataagtatcttaattctcagttttacaaagtatgcacaggacctcttccgtgcaggtatcaagactgaccaagtacattatgaaccaaaggtacaaaacactcttatgcaaaaactttaaaagtaggtctacaaaggggtcatccatttttcaatttaaaaacccggctccacagaccctaaagattctttggaacacttatgggactccctctacccctcaaacagctctacttgtatctaattaacaacaacaaactttctgcagctaaaggttgaaaactcctaaatctaattcttgccccaaattaacactcagatataccacgggccaaagaggctatactttagttgcagaacccttagctagaattcaaatattctgactcctgttcactaatgctctatccactaaaacctgctgcctcctcagtccctcaggaaatcccaaaattcagccaattgtccaaatctattctattctcccttcacaattacttcttatttctactctcctcaacttgtttcaggtctgtattacctcgtaactacatgattaagtagaattttcacctctgcagtgaggtagagagtcaggttatactacttacctagtgtcccaaacaccagtaaaaaatattgctgcttgtcttgaaaagggacagcaaaattgtttccagaatgctttcgctaaaaattagcagagctgtcccaggagttacccacatggctaagatattaaatgtgtgaacactgaagacttcagccaaaaactggataaaattgaagtagtatatttttctattccatttaatgaagcttttccctgcttccctctcagtaggccaatttcaatatcaagaatgcagtcactatcaacataattccctttggtgacaattagtaacaacagatgtattccagcagttccatacgtttacataaatgaaaatatctgtcactccaattactatattcaaaaaaagactataaataccaagatgaattgtaacatactactaaatgcaaagcatcacagtatgtaaatgacatgcctacataaaccaagctttgaaaggatacacaacaaactactaacactgctaactaaaaagcaggaatatcaaggagtaaaaggaagaacttcaacattttaaacaccaaagtattatttgaagttatcatgtaagcaaatcctttcataatttttaaaaatccaataactttttccttctttcaaaaagctgaatgaaataattcagtatcaaaatgttggctaaccactatccaatgcaggaggattcatccttcctaactaaccactggtattccctcctgtggttagttacagctattctttggaaatttgacctgatgaaaacttcactaaattctaggcacagatggctgacaagcttatgtatctggttacctcaggctcacctactactgggcctgtcaagtttttccagtggtatattttgagagttcaagacttgacacaattctttagttctttctgtgacaaacagatagtgttgcagaatggtaaggtgacactctactaagacactactaaaaacacattccactcaaactcccattcggctttacaaagctgctgaaatacacacacgtgttactaaaatacaaatgccaggaaagctcattcttctgataacttctgagcaattttcactataacctaatgttcctacagcaagaactactactttatatactctactggtgtttttttctccctttaatgcatatcaaaatttgccctttcatcctccagctgtaaagtctgactacccctagcaccactccacctcataattgaatttttaatgtctacttgccactgagtagcaaattctatgctccatgggcagacatttcgtttcacaacgtttcacgtatgctactccacagtaagtggtagctctgcagggaagcaagtaccacatagctcacaatcaatattcattactagccgcctgcctggaattctttctgcctcgatgtcctcacttccatcaggaattaatttcctttgtgactaggccttgaagaccagctgagctgtttctgagaaacatgggcattatgaccctttggggattaaaagagttaaaaaaaatatatgttagaaagatctctaccatacaaagaaagtcattaaacagctattaggaaatgcaaaaatacccactcacaatatggaaacactcctgctcaataaacaccagtcatctaaacttttatattacacttagaatatggaaccactacctctctgtctaaaaaggattaaaatagaatttaaaaattttaagtggcaaatgtttatctagaaacaactgaagataccagaagaaacaggatcaagaaagtatgtgtaagaagagaataaaattaagataggaaaaataaaataactttataagaaattacaggctgggtgcagtggctcaagcctgtaatcccaacactttggagaccagcctgagcaacagtgagactctgtctctatgaaatatttttaaaaattagctgggcatggtggcacgcacctgtggtcccactactcgggaggctggggtagaaggatcacttgagcccagacaatggaggctgcagtgggctgtggtctcaccactgactccagcctggatgaaagagcaagatcctgtctcaaacaaaacaaaacaaaaacacctccctgggcaacagagtgagacaccatctctacaaaaaagttttttaaaaaattagccgggtgtggtggtgcacacctgtaatcccagctgctcaggacactgagacaggacgattgcttgagcctgggaagtcgaggctgcagtgagctatgatcataccactgcactccagcctgggcaaacacagcagcaagaccctgtctcaaaaaaaaaaaaaaaaaaatagtaacaataaattaacttaaattaaaaaatttaaactaaggcatagaggtctttaaaaggattccaaatcatattgtagaggaaaacaaagagggacaacagaattatggtgatgggaataaagcttctattgctttaactatttagatcattgtcttaattactaatgtttaaaaagaaaactttctgctgctaaaagctgaaaacaagatgtacagcaagctatgtacgtctctacaaaattttacaagaagcaagaaaatgtaaaactttcaaaacattcactggaaaactggaagaaaataatatatcatagtttcctagtaaaactcatgctgctaaatttctaagtcaagcaacaactaccaaaacatgtcacttctatggaacaacttaattttgatggtgcaatacattactgtagtattagcaaaattacctgctgcaagacggcttcaaaaataaagaccactgctacctggatacattaatgttaaaagctaacctgaaagaccaaggagggtgatctactgaaatagtttggaataagcatatttagcgttataagcatcaggcttcacacatcctaaatggtaaataagttgtgtgttaaccaaaaaagttcattgtaattactttctagcttgttaaaaataagaagggactaatatcctctatattaaagatttcaaattttataatcattttactatagaacacatagctagctttaaaacaacagattaaaaagtaaccaagataactgaatgggtattagggcaaagagaaaagttcactaagcacatgtatcttgtgtcatgtactgtactgggcattgtatatatgcagtctcattctaaccaccatcctgtgaggtatgcgttatgtctaataagcgactgagaaaacagaggctaagagagattaagagatttgccaaaaatcagggtttcaacctaatctctcaggctccaaaattcataatataatcctttggtgaaagggacacaacttagaggcccactgataattttatttcatcagcacagtgtttttaaatccaactttcagtgttttcaaagcatgtattctctagtttagcaaatggtacttgtttagctcttgtggtaaatgagtttgcaaaccctgctttaatgcatgtcaacaaaaagagtaaaggcaagtcaacagctgttctccttgcctttccattcctagaaggcatgtggctttgactactgatagtcctagggactaagtactataatcctacctcagaggacacttacaagtacaggaacaaaatgaagatattctcaatgggggttgccctgccttttatagggcattttggaaatttctctatttttggttgacacaatgactgaggtgaaactactagtctttagtgggcaggcaccaaggatttgcaacatcccacaaagtaaggaaaagtcttgcacagtaaagaattgtcccgcttcctataccactttcaaatgacattcaagatgaaaaacttgttctgagcccagaacccaactctgttttaaatataacacaaagtattcttgcatgattttaatcatcacttaattttccaggaatgtaattactgtgtaaagtgagaatagactgttctttcgttcatttggaactctaccaagagctgttcaccttttcagaaaatcacattatcaacagcaacactgtctatagtattcaattcaccattacagcacaactgtatcggtctgaatttgtagcttggtttttctaatataaacaatgggctacttcaatgtctttctgtccagccatctcttagcacttacagactgatctaaacattgtattattagagttacttacccttattttctcctttatattacatttaggacatcagattgttttttcttcaataacatgtaggtaggtcaaaacatctatgaattttatttcaggatagtaaaagggagctacaaaaatttgctataaaaagttaacacagatagacatctgatttcactttcagtcacctatctcggggaggagagaatggggatgaaaaataacaagggtccctgtgactaaatttaacttgaagtgagagcagtgagcacactacaaagattacagaaattcgatattaaccttccctagtagagaggaataattaattcaatgaaaagactggcctattaacaaccatctaaaatgcacattttaatgatatgctcatcatttgtcaaaagagccaaccttgaaataatctggcctttctcattagtactttatttttcctcttaactttcttatgaactaccagagttgcagttaacctattaagggtaaacactataaataccatgccctataactcaaagctaaacaagcatgccatttaaaaatatagcagtttattaagcacttcagcatacattgtaatttaatcccataaaactctatgggttaagtattacactaatttttaaaacagaaaccagagtactaaaatgcaaacagacagtattacagggctactgccaaatccagtgttctttctacttaacttcattacccaacaagatgaccttttcagtatagttcttattcacattttatatttacaatggtaatttcctactttcataaaaactacaagttacttttagtactttttaaaattaccttaaatatatttcaaataaatatgggtaagtataactagggttatgtttcatgttccttaatatcattctccctggaacctattccactgttcgagtcctcttattcttataggcaccactccttgccttagcccataacaaaaggacaaaagggagagctcttacaatgaattactgataaacagggacaaaccactactaaaaactcatcaaaccatgattttcttagtactgaaatttaggtataaagtaatcacatcccataggagactgaggcaggagaatcactcgaacccgggagatggaggttgcagtgagctgagatcgcgccactacactccagcctgggtgacagagtgagactccatctctgaaaacaaacaaaaaaaaccaaacaaaaaaacaaagtaatcacatccctagtctgtctgcattgttaacatccactttctgactctctaaatcaggtggttacaattcagcaagtgaaaattattttgaacccattagaaagaaaagggtgtggtcaatcacatcttcatttatacctttttcttcttccaaaccaagaatacaaatatattccaagcccccaggcacaaatatggaaaagggcaatccttaaacgagaagtcccagaaacatccttatcatataccctttaggcaataatgccctaaatttttaaatattttaggtaagaagagggagaattgttttaaaaaaaaaaaaaaaaagcctgacgccctcagcccaccttcttctcgaaaacagctttaatttcagagaataaatgaaaaaaattactgtcagatataaggtagctgaactgaagaaaacacatatagaaatgtgaggttatcaaaataaaacaatgctactctaacctatattttctcatacaaaatttgcaatgcaacatgattttgtccatattaaatctactttaggaaggtttcttttaatacacaaaaacctcaccaaattacaaggctgtcttttaagttctaactggaaggccaaaatagcaaagatacattcttccagggttgccatattacgtaaataaaaattcttcatttttgatctgaaattcaaatataactgggcatcctatattttatctgacaaccctacactcttcaaactaaagtgagctcccacctctaccaaggtattacagcaccagctcccacttctaaagacaggctgtggcttctatcacagcaggattttaactaatgaagtcttaggagttaggatgaaagtgtccttttccaggtttttaatagcatacatttaccatataaaagaaaaagcttaatttctaatggccaaaggttatacttttactaggtttcatataaagtctaacgggctctttattatctaggcttctttgtattcaacacgtattggaaggatttcatagtttagctttttgataacaaaaagaagttgcttctgaaggttatagtaagcaaaattctgttctaatatcacaggcaagtcctaaaagctaccttaatggattccaaagttaatctaccattttacttggattcataatcatagaagtttagagctagaaacactaatttctgatctttaaaaacttctggctggcaggggggctgtggctcatgcctgtaatcccagcactttgggaggcacaggcaggaggatcactttagtccaggagtttgagaccagcctgggcaacatagggagacctcatctccacaaaaaattcaaaaattagccaggcatggaggtatgcgcctgtggtcccagctacttggaaagctgaggcaggaggatcacctgagcctggaaggttgatgctgcagtgagtaatgatcacgccactgcattccagcctaggcaacagagtgagaccctgtttcaaaacaaaacaaacaacagaaaaacacactaacttttgaaaagtccatttcatttcatattcatttccatatttttctctcattgagcttctaaacaagcacagtactatgtaagaaagagatcatttctgtttttgagtaccctctcaaccagctctttgtcctacttataatggttctgacgatgagtgcaaataactctattcttccgctagtttcattaaaatcatcttaatactaaacctatgctttcttccctgtgctctaggccattgctctttgatacagcccatccatctttggagactgcctaattcccttacttcatttacactgctaccttgaaagtattaatagataatcacatccccctagtgctccctgttcctaagtttagctccttcaggcttttctcctaaatcttaagctaccatcaacatagattctatgtctcttccaaaatgtggttagaaagtattcttatttggagttcaatcctagtagaaaacagtaatgctgttaggttagcaccatacttttgatacgtgatcactatgttatttgtgtaagggtaattcaatgacagttcactgcaagctatttgaaacctctttatacttgcttttttccaggtagcagtttcctggtttgcattaaggccatttatttcatctcccttgatgcacgatttgagattcagcattaatgaatataatttcaatgctggagctccttgtgctatttttttccagttgttcggcaatgattcccaaacctgctaaactcgtataatcaaaaaaatcccaagttaaatttaacacattccttcaatctatgaatttagaagtttttcacagatagttgccaacaaaggaggacatcttgttgcctttttttcctccaggaagcagtgtctaaaaactaggaaataatcccactactctaggatcttaaacatgaacggcagatgattctttagtgatggttctgcttaccctctctctctcttcccttggccagtattcaagtcaatctgtactcaacagaaatgtgcctcagactacagcaaccaagtaaagcatttggcttagaataaacattagtactcccagccctgcaaactcaaaggctcaggaataaggaacacaaggtctaatttaaaaggaaggtcaactgaatatactggaaaagttatgtcttgattatattcaaattactgtggcttcccctttttctaaagttctaaaaggaaaaaaaatcgctatatataatggctaatgtataaatccaaaatgttttattttctttactcataatgactaataacagtatatgctgatattactgataaatgtctagtgaaaatccttgtgttaacaaaaatcataattattccagactaacatggcatgtaaaaaataaacaaaagccccaaactactccatacctgaaaatgctgtttttcaaactgagtttcacggcccatgaattgtgaattcaatttagaaggtcactatggttctcttaactacctcacacagattaataataggtaatgtttcacaagatattacatatttgtgtaattttgttataaatttctattagtcaaaaactacttctctatctgggtcacagacaaaaaagtttgaaagcctttttctaaagagctttttttttttgagacggagtctggccctgtcacccaggctggagtgcagtggcatgttctcggctcccgggttcacgccattctcctgcctcagccccgagtagctgggactacaggtgccggcgaccacccctggctgattttttgtatttttggtagagatggggtttcaccgtgttagccaggatggtctcgatctcctgacctcgtgatccgcccaccgcagcctcccaaagtgctgggattacaggagtgagccaccgcgtccggccaagagctttatttttcaagtaatttcaacatgattacatgtgaaccaaatattatcttttactcatataaactaacccctactgactacatttcaggtcctagaaaattctagtttgcaatgtaatttttaggttatttttaaattaataagtagcaagggtgtagctgaaactagatgatgaatacacaggggtttattcattacttaatctatttttgtacatgtttgaaattctaaagatctaaaagaaaaaaaggaaaagaaatggacctaacagataacaaagtagtaccatgaatgtttacaacttgagacctttaaacacaatgtttctaaggaataacaatcaaggaacttgctaggatttaattcagttaacacttggggttgccttcttcgactataatggacggatttccaggtcttaaaaaatgcataagggactgcagaaactaactcatatatagaaaacaaactttctcgaaagataacataaaaatacaaatagttaagtgtgtttcattgtctctttattagtcaaccactttcagccaacagaaagatcataaaatacctacctacctggcaggaatattcacttctttattcacactggcaattttcccagcaagtttaatataagatctctgcataacagacacggttctgcctcccttgaaacaagaactgcaagggttgtctgaagtagatttagaggcatttagatttcaaaacagtgcatgcctcaaagttaattttcattatattcaaaagtaagtttctaaaaacttttaaacagaaagtgttatcatctctgagcctttaacctattggagacagtatctaagctataagggcaagatatttagtaatttttagaactgaaaggaaatttagacatcatctagtccaatggtttccaaatcctaccatcaggaagaaaagaatctcaaaggcataacaatttatatatgcaaaacaaactcttacttgtgtgttttcctgtatcttcctgcacatgaaatactatgccttattagtattctatcaggaaaggatgtgacatttcgttatgcattttatatttaatcacatttagtatgtgagtatccatttagatatgattaaaactattggtacgatttgggacttaatgctttctaattatagaaacttacataatatatccaaccctaatactttcagagtgatttcataccatctcatttatatttcactgtctagtaaatttgaagtaatacctgggtgaccgatgatttttaataaggcaagagaaggatatccaaattggcatatttcagccgggcacagtggctcacacctgtaatcacagcactttgggaggccgaggtgggcagatcacctaaggtcaggagttcgagatcagcctggccaacatggcgaaactccatttctactaaaaatccaaaaattagctgagtatggtggctggcgcctgtaatcccagctactcaggaagctgaggcagggagaattgcttgaacccagaaggtggaggttgcagtgagctgagatcatgccactgcactccagcctgggcaacagagcaagactccatctttaaaaaaaaattgacatatttctggaaaataccataaagtatatcataaagctccagtagttaagattatttggtaggaaggctagtcttaaaacattccataattgtttcagaaatgcaagagaataccatttagtgctttttagtacaagaaactcaatacaaaatgtttccctcgagctgactacattctattttaatgaacagataacactcagtttatttatttgaaaaacaagaaacacaacaagaaaacagcaggtatctgaggaatattaaatgtctcccctaacttactgtgtgcaagtaaatttacatacgtaggaaattctttaaatatttagaaaaccccatttctatacagatagacaaaagttctgagcaatcaggtcaaaataatctcaaattaataagagttgattgataaatgtttgcctttgtacatacacaaaagcaaacaaaagttaggcctactttcagtttcagacaatataataaattgaaattaaatacaaattttgactctccttcctaaactgaatagatccttaaaaagcagatatattttacttgtgtattcactcttttaaatttagacatcaatatcactagaataatgtttttacacaagatcacttttaaattcagtaagaagttttgttatgtatataagcctaaaatatgtaaccatttataaccaattaattttactggaggggtttcctgtcttcccgaagttaatccttaccaactaaaattaggaattttgaaaaaaaaaatccataaaaatttcacaaacaagcttacaaatgcattatctaaggtgcttaaaattaaactccatattatgaacaacattttaaaaatttgtataaaatgataatgttttgtttaaagaggcatactgaaagctaagccaatttttcacaggaggtgattctccaacattattttaactttgatgtgtgaatttactttagaggtccctggtctatttactctttctgacagcttatatttttccggatgctcctcaaacaaagattcattcctcattcttgcatcctgcttttctccttgtactactgcagcctttcttctgtctttccctttctcttacaacttcattctctacttctgatcctgtccagattgtactctcactgcaaacagtaaattgaatagaatacatcagaacgattttcataaaattcacttttccaaaactactctgcataattttattcaaacttttgttgaacatctcttgtatggtatccaacatggtcactcactgtttctctacatacttcattttaatagatattagcactttatctccttcccgaatcgttgtaaaaaacctttacacagacccagcaagtttcagagtttacacacaaaacatcttacttttaaaaagtacctcagactaatgaaaaacaatgttcaaactgacagagcacttttctaattacatttggtcatctttcaaggcccaattaaatctttttttaatttaaataattatttttatttaaactttattttaaagttaaaataaagataatataatgttgctttttattaatgtctaaaggcatattccacaaaagaaactgtttcacatcaaatctgtattaatgagaaaaaacaatgggattcccttaaaacagtctaatttctcataaggatctgtattaatcaagcgaagtcagacctgtaatgaattccaacctcacatctaaggggttttatttccttttgtggttttaaatcttggtatattcacaagttaagctctactgcgtctggcaacacaaaaacccatctgtatctctttctaatttggatccagtaaccttgtaaaacaaacccagggaatgggtcctgatgtagtaacatggcctatcctcccagaccgaaccaatttctcatgcctgggtgctgcattatatcagtagtgacattttagccagtagcctgagagactgaaagcctgtgatctccttaggaagggctttatgtcaaggcaaactatttcttctggtcaaatcttatttggattatttcaaaattttttgcttgacattcggcatgtcatttgtgccacagctgccatagataagatgtgtcttctgttgctcatttcagttcaaagaggaaacacgcaatcaattagcaaatacacctctaaaaatgtactcagtgagagaaaattgctaaaccactgaagcaaacagcccttgacagaaaagaaaaagatccatgaatcatctaatgcaaatactggcattattacaaagcacaatgttcacaactatctagtatcacccaaacaaaatggtttctaaaatttaggtcgttaaaaataagattcattagattccttattttcctccattgaacagtgttaattttgtgatgtcatattttccatatgaatatattacgtttttacacaccactccacattcattaattcagctaacatctataacactcccactgtgtgccgggtaccacactctatttctcttattcacaacaataatactctatgagaaagtgatacctggcccacttgaaagatttggttcacagaaaaaaaagaaaaaaaaaagccataaagtctctcccagaaactcaaataaaaatattaacttcctcaccagaattggcaattgcagacacagtgcagctggtcacttttctgagaaagttacataagcaaaagcacaaatctctatgtggggccttcaaatggcctatttaccatgacagcagcattaacaatcaagttttcaatatacacatgaagaaaaataaataaaaaataatgctcctttttaaaggatagtagtaatagctaacatgtactgagactcaggctgaaatctaagcggtcattatctcatttaatcctcacatcatccctagggaatggacatgattgtaatctccactttacagatgatgaactgatgaaactgaagtttgcattactcaagatcactcagctactgacagctggaactcaaacctgagtctgtcaccgtccaaagcctgcactcttgatcatcacattatactgctttgtttacactcactcaattgcagtctaatgcttttgaatgtcttataaggttactttttagaacaagttcctctttaaactaccattttgatgatacatatagaagtcaacaaataaggattttacttggaattggtcttacaagtttaaattcttggatgagaaacaaaatccatctgaatgaaagccctgaatgtccacaacaatgggtcagaaactcactggagcttcaagagaccttgagagtcatacaggccaaattcttcattttaggaataatgaaacaaatgccttttgaaaaacatctatattcaatctaaactactacattcccaattcagagatacttgtgagtttttttctccagtcatttaaatagaaaatctaacatttctaacatttcaacatcatgcacaagcaaggtatccctttttgaaagcactgtaagaaaacacaaactccatgacatgaagtcagatcactgcagggctatttattaccagctgaaagcttgaatattataataagacatgttatatagaaagctataaaatggcatccataactataggaactcaaactcaaaaatagccatctcttccttgaattaaatttacattcatttgggtcaaccagcagctcagcttcatttcatcggtcatgtcatgtgactgaattcaagctcatttcaagggaaaggccgttctatgctgtatttagaacacatatcactgagcagacagatgagtctttataggcctatccagaaaccttgctttagttgctaagaaactacaattttaccgtattataaatcattggaaaaaagctaagccagcagagattaaacatgttaagatcaagaatctctcacctattgtgcaaaatgaaactatgctattaccataaactgaatagctaaaattagcattaggcttctttaagtcatgttgacacagtcgaaaaactgataagacaaataagactaactctaccctgccttccacagtggactcatgcttagaggaaaacaggaaaaatacccaatacacttagcatattcaatgctagagacagaaaaaatgtttccttcctgacccctgcagtgatatccaaggccatgaagcacacataaaatttggtactacgaacacatatttaactgatggatattgtcaatcctttattcgttttaggaataatgaaacaaactctaacattcagcattttaaacccagtttctcaaaaaactccactggctctatcactgattttttaaaatttaaattgcagcctctctaataagagtaatcataaattgttctggcctaacaataaacaatgaaagattagcaaaaataatttatagttcactctccagtactgacttctcataaattccttcacagaaaaaatattctttaacctcttaatggctgtttccacaagggcagaaacaggttcacaatcctagactcacttgtgaaagatcaattcagcagctgaatgctaacacatgtcttcaatcagaatctgctctgtttaggtccctatgcccatgattccccaccacttctccatcttctcaaaggagcttcaattcaaaacccagtaattctctgctttctactgtaccacctcccaggggccactttcatgttcctcggaaataacgtctcttctgtcttgaaacttttaaatctcaaaaatccacttccccatctccctgtcgccagtcactgccctcaatcccaccactgcaattagttgcagctatgtgtccctgttttcccaaaggcccgaccaatatcatacagcatttgccacatcccaactcctcccttccctaatttatcctccacactgcaaaccaacattacacccccgacttcctgcattttactcccttcccttatttttcgtcttcccccacccccatctctatacccaggcctccttacttctctaataaatattcccccacctcagttccaaccctttccctccatcctctgctcattttcctctccttatttagaaactcctttttgctctcccaaccactaccctagaatgcccagcactccaccctctttagcaaacccagccctcttcccccagctcatttggagacactgctgcttctctctccaggtcccctactgcagtcaacccactccctcatcttcccacccaccttccctctatccctagatccaaggttccctgattctttaccccctcctttggtctctagtactcagctcaccattagtgttcctcaggactctcttccccccaatttcccccttatttttaaggatgtcaccagtcctacggggcctcagtagaatcctggacgaccccagctcccggggggcctgacggacaccaccatccccgtcgcccggaacacaaacgccggtcttgtgccaccctccctaagagctgcgccccctcctcatccgcccccgctactccagctccccacgtcggcttcctccgtgtcccctcgccgacccggcacgacgagccccacgacgtggagcctccgagtgggcaacacctcgggctcaccccggacgcccccgccgctcggataggagcctccggtcctcacacccgcgcctcctcaaacccgcagccggtacctcctctcggacccgcagcccctcagacgcccactcggcccccttccccgagctccagcgtctcctcaggccagagccgggccccctccggccccggcgcccctcaacccccgcccggcccgcccccggcgccccgcttaccgttctgagcggcgcctggccctgggaggagggagccagagaccagcaacagcgagagggccagggcgctgggcagcgacgaacccgacatcctccctagcagaagacccaacagcgaatgggccggggccagagccggggccggggaagggaggggagggagggagggggcgggcgagtgcgcgagggagtgagcgagggaggcagccgcggctcggctccgtccttccccgtcctcctcctgccgccgcagcgcccaggcctcgcgagaccttcgctccgggtcgtgggcggctgaggagcgaccgccgcaaggatcgcgagaagaggcggctccgacggagactcccgccccgcggactcggtggccccgcccctgcagaggctgattggcctagcgcgaggtaggtcacgtgccgagggcgcctctggccatgtgacggggcgaggcgggactccgctagctctctgggcagtggggagctgggaagtccttcagtttactcctctgtggcccgggagcacccataaataagaggaagctttggaacacagtacatttcctccacccatcctgcctttcatttgttagcgctcttggctacagagtttcatacaccgtgcctcctttcctccttcctctctttgtccccgtcctgctgtttcttccttctggactttgaacatagacctctactggtaactggctccaacctccttctctcatctgctgttttttccttccaggaaaagtggtgcgccccctgtgcccccgttaccttgtgctttcctgcctggacatctgctccctttgcctgaaatgtcctcctttgccgcctctgcctactccccctcccaccccacatctgggccttattttagcttcatagactctcagggcctgaagttcagctagcctaattgcatgttcattgacacaattctacaaggaagtcgtgtatgaacttacatgaagactcctaagaagcgtcttaatgcggaaaacatttattgagaacgtgctgtgtgccaggcacatagtgaaacccacatgaaaaggtagtccccgtcctcatggagtgcactgcctaggctagcagaggagtgaggaagggtcaaatggccccataggaaaggatctagcaaagcactctggagggtgattggcagtgtggttactactgtttgcatagaagtttgggaaatgctctttttaggggtattttttgtactaccctcagggcttgtggttggcaaaggaatttctatggcttagctcatccctgactcacagcagacgtcctgggagtgtctgtggaaactctgaggggccaagtaaacagtcctggtggcctgacttgatttaaagagagggtttggaggacctggaagaaggagaccctcgcaatctctatcaagctaaagtggtctggaactttcaacaggaactgaacagctggtggttccagaccaaaatttctagcaaaggccaggaccactatggcatgttgttgattgaagtgaaaactatgtccttcaaaacctcaggtgtgtgagtgacaaaaagattggcatgtaccttcatctggacaaaggccattctgcagacagcccagtaaggagggctacagggctgcctgtggtgggatcaagattttcagctgatggaagctttggttggatgcaaccattctgcctcattatagctgtaacaaatgtggctctttgatccttacaacaagagattcttacaaaatgatcatggtctttttgtggatagggaagctgaagccaaaggaggacacgaacggctccagctctcagaatgtttgtattaatcattaatgccaacaatctggtttgcttgttaatagactcatggtagaagtgcattttcttgtccccttgaagtcgggagtggcattggatgtgcttgggtcagtgaaatgtgtaaagtaacatgcattgcttcaagcagaagcatttcatttccagtttagactctttcccatactctttcgtcttggtagtgattactgatcatgacgatgaaagcatatatcaaaacgaaccttgtgtcagcattagtccctgagttagcataataagcttaacccccctgctaacccatacagaacaggtaccctctgttgaattaaactgtgagattcaaggggtatttgttcctgtgacataacatagactgttccggctaatggaaagatgaaattcaagtccacaacaccaacattaccatccaggagctctgtcatcttaggcaaatgacctaatctctctggaccttattttctgtcaaatggtgctaatgatagcacctaccttccaagattatagaaggaataaatgagtaaatttatgtgcaatgtttagaacagtttctggtgcatagtaaacactcatgttgatgttgatgctgctactacaattctgactccagctttgtattcttcttcttatctcatgcttgcaaaaagtgatctgggaagaacatttttaagtatgggtgttaccagtcaactctcaaaacctgcagttatgaaaaaacccttttacccagggagaaatgtcaccaaattccacatgatagtagctgtactttgtcacttttcatcgagaaaatacataataactaagaccttttaataattctgtaattttttttttgagatggagtcttgctctgttgcccaggctggagtgaagtggcgggatctcggcttactgcaacctccgtctcccggggtcaagagattcttgtgcctcggcctccaaagtagctgggattacaggcatccgccagcatgcccagctaatttttgtatttttagtagagacaagagttttgccatgttggccaggctggtctcaaactcctgacctcaggtgatctgcctgcctcagcctcccaaagtgctgggattacaggcgtgagtgagccaccatgcctggtctaagtcagtaacttcctttttttttttttttttttttttttttgagacggagtctcgctctgtctcccaggctggagtgcagtggcgcgatctcggctcactgcaagctctgcctctcgggttcatgccattctcctacttcaccctcccgagtagctgagactacgggctcttgccaccacgcccggctaattttttatgtttttagtaaagacggggtttcactgtgttagccaggatggtctcgatttcctgaccttgtgatccacctgcctcggcctcccaaagtgctgggattacaggcgtgagccaccgcgcccggcctaagtcagtaacttctttaaaagaatttaggaatttgtatttttttgttgttcaagatttacatacactgtaaaaaaaaaaaatctctgcaagtgtgtgtggctgtgccagaggatggctgagctctttgcaataccttagaagagccctaggggtcctcagagctcaagctgagacacacttacctggcctcgagggactgcttgtagttaggctctccgttgctgatcgcgccccctggtggaaaggtctggaatacagcattcccaactgaaaggcttcgcgtggtttggtttgaacgtgattcactcaaggatgttagtcaaaaggcttgtactgttcctagagttgaccttgaacttcctaatggtttcctccctcttgtaaatatctctgcccctttaaagctcttgctattcagatgaccaccccactcatcttgattgttgtcatcctccgacctcccagtcaatgtaatcttttccctgccccttccgatgcctgctggcaccatccttgaacttcatccttgggtgagttcaacatccatgttcgtgacctattcagtatcctgatctcttaatccttttaccttctcacgtccaacaactttctcctcaattaaaccaacacttctgagctcacactgtcaacactttaatcacccaaaaagtacttcatctttgaaatatgaaaatgtaataccccactgtccattcaccaacacctagcctttcagttccttgtgctaataccctatttgctgtaattcttcaacctcactgagaccactaatctgctaataccaccaatttgtctttatccattcttcatttctttcttggtccaatttagagcccatgattcatcattataatcattcccttgcccacctcaactttcaacatactttcctggaaaaaccacgacctgactgagcactatagtctgaagtaaggtaccatgcctgtacctgagcagctgagtgttgccagagaaaaatcatacaaaccttctaaatgacttcattttaaattcatgatctcaaacttcaaaaggatattcaacactactcagcaatcctactctttcatatgcgataagcatgaatttgcaactacaatggtcacttgccagaaatgcctcatttttttctttctataaatcagatttaatctagtctgagtacctttctgctgagatgacaagaaattcaatgttggcttttatgagcctccgtgactacttcccaggataatatgaaattcctggtgttttacacagcctaggacattcctttttatttgctttttagttcaccatggtgactgctggtaggaacattgagcagatccacgtgattccttgaaggtgaatggctcagtgcttcccaccacttcccccagcagcctcaccccacaccacattccctttcagttctttgtgatggttctgcttcatctcaccttgggggcctttgcatattttgttctctttgccccaaatactgaacaacccatcttttttacctggtctacttctcatcctttagatctcagcttcaactcatctctcctaatatgaaattttaaaccacagtgaagtgccatttcacatgcacatatttaattcaataatttttaaatgctgggcacagtggctcatggctgtaatctcggcactttgggagaccaaggtgggtggatcaattgaggtcaggagttcaagaccagcctggccaacatggcgaaaccccgtctctacttaaaatacaaaaattagcagggcatggtggcgcacatctgtaatcccagctactcagaaggctgagacaggagacttacttgaacccaggaggcggaggttgcagtgagccaagatcacaccactgcactctagcttgggcggcaggatgacattctgtctcaaaataataatagcaataataatttttttaaacctgaaaataccaaatattgatagggatgtggagcaacaggaactctcatacattgctagtatgcagataaaaatggcaaaattactttgaagaactgctgacagttttccatcaagttaaatacatatctaatctatgaccaccaattctactcccgaatctcagtgcccaagagaagtgaaatatatgtctacaaaatgaattgtacaagaatgttcatagcagctttattcataatagccaaaacaggaaacaacccaaatactcatcaacagatgaatggataaacaaactgtggactagtcatatgatagaatactactcaggaaaaataaataagtaaataaattattgacacacaacaacacggatgaatctcagaagaatgatactgagtgaaagtgagacaaaaaaaatgtatgtatatatatagcatagttctacaaagttatagaataggcaaaactaatttacattgacacaaatcagatcagtttcagtggtttcctgggacagggagggtattgactgaaagggacacaggggatgttctgggtgataaaaattttctgtatcttgatctgggtgatagttacgttagtgtatacatttgtcaaaacttatcgaagctacacctcaatttaaaaatgaaaacaaaaacatctccttatcaaagcctttcctgggctccacaactcagttaaacctcattctttctttctttttttttttttccagacagagtctcgctctgttgcccaggctggagttcagtggcatgatctcagctcattgcaacctctgcctccgggttcaagtgattctcttgcctcagccttccgaatagctgggattacaggcatgcaccaccacacctggttaatttttgtatttttagtagagacggggcttcaccatgttggccaggctggtcttgaactcctgacctcaggtgatccacccacctcagtctcccaaagtgctggaattacaggcacgagccaccatgcctggcctaaatctcattcttaaacacactgattgttccatgcatatcttcatggctcttatcacagctgggattttacatttatttgtgtggttattcaacttgcatctgaatccttctctagacctccaggaggagggaaccatgaccaatggtatcagtattatttaccactgtatctctgttgcaggctgaaagaatgagggtcatgatcaactcagtataccactggaggctctgtgagtaaacagcaaactgttttcatgaaagcaggatgttggcaaactgacaaactgcgtctgccgcccagaaggaatgctgagggcagtcacgccccaagcagtgtttcttgtggttaggcacatctgaagcctgttagcagtaatgtgaacctgtgatcaattaagcagctgaccaatcgttacctcctcctccctgctctttctacccaataaatacgaagggctgtagaagctcagggctgcctttgctcactagaagcagggagccttcttcttccccggaccccttctttaaaacggtttcttttgttttaagttttcatttctgtattcatcctccttcgttcagtcctgtggtaaccatagtaaccatggcaaactgcagcatatctccagtacctactacagtgcctggcagtgggcatttagtgaatatctcctgaatgaatagacaaagcatacagctagactcagaatctcagactcttgcctctcaatccagtgctcctttcagtctgtcactatgatgttggagtccagttctgcctcaaggcccgactctaattccacttattctggaaaaccatctctgttcaccattcattcagtcctcattaatttcacaaatgttgggtgcatagtctgtgcaagggtatggtatacaatgatgacagggaacatagacattgaacaacaatgataccattgcttacttaatgataattttggtccatgataagagtagacatattggatgctaagggaatatgttacagggaaacctaactatgtctgaggtgggaggagtggtcaagaaaggctcctggaggaagggacagcaaagctgtgctctgaaggatgcttaagagttagccaggctgtcaggcgcagtagctcacgcctgtaatcccagtactttgagaggccaaggtgggcagatcacctgaggtcaggagtttgagaccagtctagccaacttggtgaaaccccttctctactaaaaatacaaaaattagctgcacatggtggcacacacctgtaatcccagctacttgggagatcgaggcatgagaatcacttgaacccaggaggtggaggttgcagtgagctgagatcacactactgcactccagcttaagtgacagagcatgactccatctcaaaaaaaaaagttagtcaggctaaaaaataataaacaacaaaaaattatatctagaggcaaaaataaactaaaaaataaaaaacaaatgaacaaaaaagaattagcctggcacagataaggtaggcctaggtaggggaggtctgttccaggcaggtttaaagggttggaagcaggaaggagattgtcaaggtctgcggaggatcccagtgtgcctagagctcaaacagcaaggagaagcggggcaaaaggagctgaggctgaaggaggggcattggggccatatcaggcaatgccttgaggaccatattaagggtttaagatgttgatcatctatgaggtaacctgtagctttctttaacaaaatctagtccagaacctctttatttgtcaataaaagaaatctatctgtaaataccgtaatatattaaagcagaatgagtcgttaagctgtgctacctataagcctgatcacatgttactctccatcatcatttccttctattagtaacgttttacttagctgttcctccaggctcagctgtgctgcacagaattaagggaagggccatttgtcctttgggtcagaacataaatggccaggaagcctcccctaaggtcatggtgtggtggctgttgtctccaagtagaaagtgaatgcagcacagagaacaatgcaatgaattgtgagggaggaccagttctccctccacacaaggagactctctagcaattgccaaggctgcatgtccagccctcaatgcttccttctgcctcccaatacctataaagctcctccctataccattgaaaaatgttaccaagccttgcatgacgggctaattttgcacctctccacatccagtctccccatctagaacacgagttcattataacaacgtcttacatgctacagcttttcacagtttacaaagcatttcccacaataggaaaaataaagcattcattatcccattatttcacttggttatcacaacgaccaatcatgttcatttcataaacaagataactaggcttcagaatggagaatgccttgttcaaggtccccagctggcaggtaatagagccagaatttgaacccaagtcctttggacctcaaaggaaatatgctgagggtggctgagtcactttcttggggaagatgatctcttgcaatgaccctcctcagacaccatgagtcttatctgaagataaagcactctctttgggcaagttctccattcaagatctgctaaggctggtataatgttgtttcacctcctggccccagaagtttgaggtgctcataatttcttcagggagcatcttgggtaccagctctactatgatggccaatgctcaaatggggcagggcaactaaacagctgaggtaggctctctccactgttggggttggggttttagtggctaatacaaggcattcttttaatcccttctcaaacttggaaacaactgagagacggacacaggagtcaggcatatggaggtcaaaatggtggagaacatggcttagtctgctggccaagtgagcttgctaacactttgcccctgaatttggcagacttattcagagatgttggtagtgcaggaaaaccacaagtctcccatggccactggaaaacttagggcagcatggagaagcagaaccactcatctgctctctgtaggacgccggtcccaggcttgctcaagtccttccgcctcagttgtccaccagaaaactcattcctgaagccaggaggggaagcaagtaaaaggaggccacacatgtcacaataatgaagtgattctctgccccagctacacattagaatcaactagggagcttgaaaaaaacaccagtgccaaaatagatatacacaacaatgtccaggttccagccccagcgatttaaatgcaattgatctggggatggggcccagcttgcatagcagagtaatgcactttaatgtgctgtaatgcactgcttctcgaatgttgatgcacattggattacctggggaaccttaaaaaatcccaaccctagaccacaccaattaaatcagaatccctggaggggagacccaggcatcagtatatttttaagactccccaggtgattccaatatgcagccaaaattgagaacaggtgctcaaatgtggttgtgttgttgttgttatcgtttcaaatttgagtgttcagcagaatcacaagaaatgtttgttaaaagatggacttctgggcctcacccccagagtttctgactcagtaggtttgggttgggggcctgagaatctccatttctaacaagctcccaggtggtgtggatactactggtttggagaccacactttgagacctgctccttcacagggtgtgcagagaagcgtttccttcatcagctgagaaagccatggtaagacctgatgtgataactttcatccctgcaggtccacagaaaaatatgccaaagtcagtagcattggcctacatgatgttttaaagagggttcatagattctgactttaaaaaagagctgcctcatcgtggctagtgtcagaatgcccaagatgctctttattttggtgctctccttctcacagttgggaaactcatttctggtttttaccaggttaatggttggttatagttgaaacagagatgccttctgagtattgacattttctcttgagaagtgctcccatctacgtagctctaattggaccactccattcttacaagtccctgtttccctgtttcgttcaggggtggtcaccagactcaagccaggccatccagaagccctggaaaatttttgggttaaaactgaggaaagagagtcagtttctctcttctccgtgttataagctatgagatgtgagacttggggtgaaactaggtttcctctctactgtgagctcctcaaggacagagtgttatttactgccatatttctcagtgtttagcatagttagtggcacaaagcagggcatcaaataaatattatacacagttttgatgaggtataagtgacatacaatgaacggtgcatatttaaagtattcaatttgatatgttttgacatatttatacactctaataaacagattttcagattgaattaaaaaaataatacccgactatatgctgtctctgagatagccatttcaaatatgaagccacaaatagatttaaagtaggagaattgaaaaagtatcccatgcagacattaattaaagagaagccagaatgactgtattcatatcaaagtggatttcagaagaagaaatattatcagggaatcatagtgatattacataatgataatggggtcaattcaccaggagcacataacaatccgaaatggtgtgtacaacagtgctttattatgcatgaagcagaaactgaaatgcaaaatagacaagtcctcaattatagctggctattttaacacctttctttcagtgattgatagaaaaagtagacagaaaatctgtaaggatatgggagacatacaacacaatccatcaactggatctaatagcatcgtctacctaataatagcagaatatgcattctttccaggtgcgcacagagcattcactaagataggctgtgttccagactataaaataagtctcaacaaatttaaatttattgccaggcacggtggggcatgcctgtagtcccagctatgcaggaggatcccttgagctcaggatttgagaccagcttaggcaacatagtgagacccccatctaaaaaaaaataaataaaaagtagtgaaatcatgcaaactatgttgtctaaccacaaaggaatatactactaaaagtcaaaaagaaaaagatatcttgaaaatcctcaaagaattggaaattgaacaacacacttctaaaaagaaaccaaagaataaataataatggaaatttaaaaatattttaatagtccattacattaaagagatgtgaaaataagaaaacatatttagggccaggcgcagtggcttatgcctgtaatcctagcactttgggaggccaaggcaggtagatcacttgctctcaggagtttgagaccagcctgggcaacatggtgaaaccccgtttctacaaaaaatacaaaaattagctgggcgtggtggcttgtgcctgtactcccagctactttagggagctgaggcagaagattcccttgagcccagaaggcagaggttccagtgaatggagatggcgtcactgcactccagcctgggtcacagagtgagaccctgtctcaaaaaaaaaaaaaaaaaaagaagaaggaggaggaggaaacatatttagtatacttatattcacatttatcttttctcttttctttcttttttttttttttttttgagatggagtctcagtctgtggcccaggctggagtgcagtggcccagctcggctcactacaacctccacctcccgatttcaagcaattctcctgcctcagcctcccaagtagctgggattataggcacatgccaccatgcccagctattttttgtatttttagtagagatgttgttttgccatgttggccaggctggtctcgaactcctgaactcaggtgatccacctgcctcggcctcccaaagtgctgggattacaggcatgagccactgtgcccagccacatttatcatttctatactcttcattcttatgtgtggatgcaaatttccatctggtatcattttccttctgcctgatgaactctctaaacttttgcctgagaaagtctttatttcaccttctcttttgaaacatattttggctaggcacagcggctcactcctgtaaacccagcattttgggaggccaagacaggaggcccaggagcttaagaccagcctgggcaacatggtgacatctcatcttaaaaaaatagaaaaaggagagaaagaaaggaaggaaggaaggaagggtattttttttttgtcaggtatagaattccaagttaacagattcttttttcaattctttaaagatgtcattccattattttttgcttggcataatttcggtgaaaattctactataatccttgcctttgttccattgaacataatacgtcgttttttttctggccgctattcaattattttatttatcactggtttttcagcaatttgattataatgtgccttgatgtttattgttttctttatatttgttccatttggagttcattgagcttcttggatctataggtttatagctttcctcgaatttggaaaatcttatgccattatttcttctcataagtttctattcttctacccttctgcaactctagttacacttattttattttattttattttattttattttattttattttattttatttttgagatggagtctcgctctgtcgcccaggctggagtgcaatggtgtgatcttggcttactctccacctcccgggttcaagtgattctcctgtctcagcctacctagtagctgggattacaggctcccgccaccatgcccagaaaatttttgtatttttagtagagacagagtttcaccatgttagccaggctggtcttgaactcctgacctcaggtgatccaccttccttggcctcccaaagtgctgggattacaggcgcgagccaccgcgcacagcctgtcacgtgtattttagatcacttgttatcatcccatagaatcactaggcttgtgttttgtttttgttttgtttttgagacagagtctcactcttgcccaggctagagtgcagtggatcacagttcactgcagccttaactttctgggctcaaaggatccttccatctcagcctcccaagtagctgggaccatacgcttacgccaccacacccacctaatttttgtattttttatagagatggagtttggccatgttgccaggctggtctcaaactcctgagctcaggtgatccacctgcctcggcctcccgaagtgctgggattacaggcatgagccactgtgcccggccacatttatcatggaggagggggagggggaggggggaaagggaggagaaggatctgcccacttcagcctcccaaagtgctgggattacaggcgttcactttttttcattctcgtttttctctgttttcttcattttgggtaaatattgctatgtcttcacattcactgacctcttttttctagtgtttaacctgctctcaatccaaacttgtatagatttcatttcagataattgtgtttttcattctagaaattccatttgggtcttttaatatattttctttgtctcctcgttatttttatgttttccttttcatcttaagcatatttgtaagatttaaaaatagctttaaaatccttgtctgctaattctatcatctttgtcattgcaggtttttggcttttttttttttttttttaagagacaaaatctctgtctcactctgtcacccaggctggcgtacagggtgacacaatcatagctcactgcagtatccaattcatgggctcaagagatcctactgcttctgcttcctaagtagctgggactacaagcatgctctaccacaccctgctaaataaaaaaaaatttttttttggacaggtggggtctcatgatgttgcccaaactggttttgaattcctggcctcaagcaataatcccgcctcagcctcccaaagcgctgagattacaggcatgagtcaccgtgcccagcccatttctagtattttctaatgatgcatttttctcttcactataggtcatcttcctgctgatttgtatgcctggtagtttttcactggatgctctacatggtaaattttaccttgctgattgctaccctttgttgcttttctttaaggagtattgggctttgtttggcatgcagttaaactattgcatatcagtttgatctttttgaggcttgtttttctgcagttacggaatcagaacagccatttttctaggtgtatttatgtcttctgtcaaggccttctgcttctgagaatgccctctattttacaaagtctctttactctggctcatgggaacaaaaacgagttctagctgtgtgtgagctccaggaattatttgaacaactgttttccagtggtttttaccccaccctcctggagtttcaccccaggcatgtacagatcatcactcagccaaagactagtttagaggatccttttgcagatctctagagctttctggtgtgcagcttcctccttccctgtaggctgccccacaggttccacctcagcctccccaaattccagtctctgtcttctaaactcaacaaggctggtggttctggatgggtccctctccctgcgctagagccagaaaactgcctgaaggcagcaattgcagaactcccaatacctgtgccccttcactcagggattgcagtcctgtgctgcccacgttgttttatatattttgcttggtttactagttgtttataatgggattgcaatttttgtagcacttaatccttcataggaagaagtacaagttagagttaactacttttaactgtttctcttttagttcttctactagttgctttcataaggttaaataatattctgaagccaacatttttttaatctttcaacttcctgctatgaatgatgaagattcagcctaccctccactttctccatccctcttcccagtttgaatagttacgtgatgtttttgttgttgttcttcatttactgtgttcaagtattcagtagtatacttgacaatgtatttctcacgccgtcatcttttttttttttttttgagatggagtctcactctgtcgcccaggctggagtgcagtggtgctatctcggctcactgcaagctccgcctcccgggttcatgccattctcccacctcagcctcccaagtagctgggaatacaggtgcctgccaccaggcccagctaatttttttgtgttttttagtagagatggggtttcatcatgttagccaggatggtcttgatctcctgacctcgtgattcgcccacctccacctcccaaagtgctgggattacaggcatgagccactgcacccagtcactccatcatcttttgataatatctttggatcttcaattactgtgtaagatgaggttattggctgggcaaggtgtcacgcctgtaatcccagcagtttcggaggcccaggcaggtggatcacctgaggtcaggagtttgagaccagcctggccaacatggtgaaactccgtctctacaaaaaatacaaaaattagctgggcttgggggcgcacgcctgttatcccagctacttgggaggctgaggcacgagaatcacttgaacccgggaggcagagattgcagtaagcccagatggcagtgagccaagatcacgccactgctctccagcctgggtgacaaagcaagactgtcacaaaaaaaaggttttttgaaaaaaaagatcttgaacccgggtggcagaggttgcagtgagccgagatcgcaccactgcattccagcctgggcaacagagcgagactccgtctcaaaaaaaaaaaaaaaaaaaatgaggctaacaccctacccttcccttcatttctatttcctgacttccaactccctgcttatttaataacctataccctttattcccacattgctgtagttcctaccatttatattttgctgtgtaaacatatttaaatcttctgtgctttgcctagggattacttccaaaagttgaaaactaatagaaaataatgtatattattgtcattaagaaaatatttactggccaggtgcggtggctcatgcctgtaatcccagcactttgggaggctgaggtgggtagatcaccaggtcaggagattgagaccatcctggctaacacagtgaaaccccgtctctaccaaaaatacaaaaaattagccaggcatggtggcatgtgcctgtaatcccagctacttgggaggctgaggcaggagaatggcttgaacttgggaggcggaggttgcagtgagccgagaccacgccactgcactccagcctggacaacagagcgagactccacctcaaaaaaaaaaaaaaagaaaagaaaagaaaaaaatatttactgcagagccaagctgtgtgatcaacttacaattccttctttatgaggtcaataatacaaacccgtaatacttgaatgagtcgaggtccaatggattctattttgcttcatatttggaccatgactttgttgtacacattctttcctaaaatttctaattaccttcctcttgtcgagaaaactaatgtaagactaagccactaagctcttccagcttcttatctaccatttttgctgagaatcaattctactcttcttcctgaagacattcttgttggattctactgatctgtttttctttttctttttctttttccttttttttgagatgaagtcttgttctttctcccaggctggagttcagtggcacaatctcggctcactgcaacctctgcctcccaggttcatgtgattctcgtgcctcagcctccacagtagctgggactacaaacatgcctgccaccacactcggctaatttttgtttcaccatgttggtcaggctggtctcaaactcctgacctctggtgatctacctgccttggcctcccaaagtgctgggattactggcatgagccactgcacctggccaactgatctgtttttctgatatgaaatgattggcttctagatctgttacagtatggtcttagtgaaactcttttccccagatgagcactacaggaagtattgtaatgaacactggtagattccccaactcacatcccactcagaggattagtctagattaacaataataatcccattcattttgctagcgattggttcagaattgtgactcaattctggctaatgagacacaagaataaattagcaaggggacttctgggaaagattttcgtccctaagacgggaaaaaacagaaaacacagtcctttttctttgtctggacattgtcatatctaattagatatgacacctggaattgtggcagccatcttgctgtcagcttgaagctgaagccaacactaaggtggcagaacagagatatggaaacaacctgagcttcagatgatatcatggagctaatgactcaactaattctggaagccctgcatctggactttctgtttccttattgcttaagccagtttcctgtctcttagaaccaaatattttgtatgtaaaaaattctgttagtttcttgcacaatactttttctcctcttctttattactaggagaacctcattttttcccacagagaggcattatacaaaagaaaagaaagaaagaaggcaagaaggcaagaaggaaggcaagaaggaaagaaggaagggagggagagaaagaggctttgcccttcagattccttttttcagctagagatgactctaagacccatctaattctagcgaatgagatacagatacaaatttctgagtagggcctcaggaaaacctttttaatgggaataaatttggtcttcatacttcctccttccttctcactgagaatggagatttgatgcttggaattactgcagccatcttgtgatagggagggtgaagaccaaatgctagggatggcagaaatggaaaaagaagatgtcaggaaaacttaggacatccctgagctgctaagccagtcataaaatgcctgtgaccagacattctgtgatgtgggaaaaataaaaccttatttctttaagctgccattaattgcaatatagataatacatcaagaatccaaccgcttcctcttccttggttttcaccttcattttgcttgatgatatcctcaagattctctctcttaaaaagtatgtgagatagatgctttcttagcctttgtctgtctgaaaattccttattttgttctcatacttgattgatagtttggatgtattatacagtgctagcttaaaaacaattttctctcacaagtcttaagacattgctccattttcttctggcatttaatgttaccgatgagaagtccactattaatttgattttgcaccaatgcaagtagtttaaaaaattttgggggggagcttttaaaaaattttatttttggtgttctgaaatttcacaatgatatgtcaaggtatgggtctttttcactcattatgtgcaatacttgctgggctctttcaatctgaaaactattatgtctttattacttgagataaattatgaccttctgtgctcttttattctctttctgaatgtttgactttctgtattgattgtctcttatattttctatcatatttcccatctcttttgctttttcctctatgttctaagagatctcctttatctgccaattcttccattacatttctaatttcagccattacaattaaaattttaagaacagtttcttggttgggtgtggtggctcatgcctataatcccagcactttggaaggccaaggcagaaggattgcctgagtccaggagtttgagaccagcccatgcaacaaagtgagaccttgtcttcttagtaaataacaacaacgacaaaattaataataacaaggaacagtttcttattctatgattgttcctttaccatagcaatctatacttgtttatggatatgttatattttaaaagtctctctggaaatatagtttgtaacggttttctgttgtctgcattctttattccttttgagccagttttttaaaaaatatatttttatcatgatctgtttcttttatttgtatgtgcaatgatatacatttgcttttttatatttaagaaagagaggccgggcgcggtggctcacgcctgtaatcccagcactttgggaggccgaggcgggcagatcacgaggtcaggagatcaagaccatcctggctaacacagtgaaaccccgtctctactaaaaatacaaaaaattagcctggtgaggtggcgggtgcctgtagtcccagctactcgggaggctgaggcaggagaatggcgtgaaccccggggggcggagcctgcagtgagccgagatcgcgcccctgcactccagcctgggcgacagcgagactccatctcaaaaaaaaaaaaaaaaaagagaaaccgtgttgatttttctgggtaccagttttgagtttcctgggtactgcatgaagctaggtctgttttcccatttagtatctcctggaaggaaaaagttggccaggcataataatgaagtttgttcatgaagtttgttccgggcataagatgaagtttgttactatagtgagactgggctaggagttgacttttagcactgggggaagggtattctctatggttagtcccatctagctgagctctacatgactagagatagcaaagggcgtggtctaaggagggcaccttgggaagttgttatggaaagacttccacttaatctctgctctcataacttttctttcctcaccagccagctcttgggctctgctgggtgtacctgcccctcagcttccttcacttactctgcacagtgggcccacttctacttctcatccatcagcggcttctctccacttactattttctgcaaatctcagaacgtctctttttggtgatggtctactctcattctctgctctaatcagatcattttcttctgcttttttttttttttttttttttttgagaagaagtcttgctgtgtcgcccaggctggagtgcaatggcatgatcttggctcactgcaacctccacctcccgggttcaagccattctcccacctcggcctcccaactacaggcgtgcaccgccacgcctggctaattttttatatttttagtagagacggggtttcaccatgttggccaagctggtcttgaactcctgacctcaagtgatccgcccaccttggcctcccaaagtgctgggattacaggcgtgagacaccacgcctgttctcattttcttttactggcattctaattgagtttcaggagggagagaaggcaaatgtttgtgcttggtccatcatctttgctaaaattttatttttaatttttcatccatcttcataaatgagattgttatatagcttttcttttcctttatgtcatgtttctttggttttgggttcagggttacaggaactttaaagaatggttggttcacattccatgtatttctatgccctgggatagtttaaattcatccacatattgatccagtaacttactgcattacagtcacctgggaatatattttaaagtacatatttcacttgtcttcgtataatcacaggaaaaatatggaaggatgtatataagttgttacatttatacacaaactaataaaatttgtttcagcaggagtaagatcagggagaaaatggggagacaatttttcttttgtatattgttggatgttttttacaaccactaaatgtaacttctgaaatgaaaaaaaaaaatctttatgaaaaatatagattcccaggccaaattttggagacttaagtttgttgagtctgggaagccaggaaatctatatatgtttttaaaaatgtacctaggtaattgtgatatgcaatcaagtttagaaacccctagtatagatattataggaattagttttttcttgaaattgtgaagtacttacctatagaaccccacagccctgaggcttggtgggggagggcagggcaggtggacggaatgtcgttctttgactcctttttacaatttgtcttgtagagatcaaaatatgccactccaaaacatgccactttggcatacaattatttcagattcaacagatgcagaaagaagccatctcagagcttcccttatctcatgagaagcagaaacttctgagaaatgaggactgctgtaaatctcctcttctagggaagttttatggccacagagaagatgaagttggcgccaagatggatctgcacaaacaaaccttactccattaatttccctcatatatttactttcccatggtttactgcctttgggagcctaagattttttttttttcctttgacttgtcacttctctacgaatttattgttctttgttaagatgcataaacccacattctaaccacctctttgagtttttcatcatatcactgagtttctcctgggtacacgcccactgtacatgctaataaactatttgtttttcccttgttaatctgttttttctcagttaattttcagagccccagccagagaacctatgtgggtagaggaaaaagctcccaccctcttaccgtcaattttggtattttatgcatctcctgggaaatcatccattctattaaatttattagtgaaaaattagatctactaattttttattagctgtacacttaccctttttatctttattttgaactcctttcttattcttagtatttgtgattactctgtttttcaaaaaaaaagttttattgtggtaaagtatatatatataacaaaatttaccattttatccatttttaggtgtgcagtttagtgccatttgttcactcataatgttgtacaaccatcaccactatccatcttagaactttttcatcgtcctgaacagaaattctgaacccattgaatagtaactgtccattccttccttccctagccactgctaacctctgttctactttctattcctataaatttgcctattcttggcacttcctataagtggaatcttaaaataattatccttttgtgtctgacttatttcactcaacataatattttcaagatttatccatgttgtatctgactttcattcttgttaaaggttgagtaatatcccataaagtgtgtatatatcacattttgtttatccatgcatctgttgatgtccgtttgagttgtttccaccttttggctattgtgaatcatgctgctatggacattggtgcacaaggatctatttgagtccttacattcaattattttgggtacatacctagcaatggaattgctggatatggtaattttacattaaaatttttgagcaactgccaattgttttccacagaagtgacatcatcttatattaccgcccacaagatacaagggttccaatttcttcacatccccaccaacacttattttcttattttttttttaaataatggctatcctaaccggtatgaagtgatatctcattgtgtttttgatttgcatttccctaatagccagtgatgttgaacatctgtcatgtgcatattggccatttgtttatcttctttggagaaatttctattcaagtcctttgcctatttatttatttatttatttttctgagacagagtctccctctgtggcccaggttggagtgcagtgcgcaatctcagctcactgcaacctctgcttcccgggtccaagcaactctcctgttccagcctcccgactagctggaaccataggcaccaccaccaccaccacgcccggctaatttttgtattattagtagggatggggtttcacgatgtttgccagactggtctcaaactcctgacctcaagtgatccactcacctcagcctcccaaagggctgggattacagacgtgagccaccgtgcccggccgtcctttgcccccactcccctttttttttttttttttttaagacggagtctcgctctgtcgcccaggctggagtgcagtggcgcgatctcggctcactgcaagctccgcctcccaggttcacgccattctcctacctcagcctcccgagtaactgagactacaggcgcacactggcacgcccgggtaattttttgtatttttagtagagacggggtttcaccgtgttagccaggatggtctcgatatcctgacctcgtgatccgcccgcctgggcctcccaaagtgctgggattacaggcttgagccaacacgcccggcctgcccatttttttaaaattgagttgtttgtttttttgttattgagttgtaagagcttctctatttttttttcctttggagacagagtctcgctctgtcacccaagttggagcgattctcctgcctcagcctccccagtagctgggactgcaggcacgtgccccatgcccggctaatttttgtattttcagtagcttcggggtttcgtcatgttggccaggctggtctcaaactcccaacctccagtgatctgcctgcctcggcctcccaaagtgctggtattacaggtgtgagccattgcacctggccgagtttctctattttttattatttatttatttatttattttgagatggagtctcactgttgtcatccaggctgcagtgcaatggtgcaatctcgcctcattgcaacctctgcctccgggttcaagcgattctcctgcctccgcctcctgagtagctgggattacaggcttgcgccaccacacctggctaatctttgtatttttgtagagatgggtttcaccatgttggccagactggtcttgaactcctgacctcaggtgatctgctcacctcggcctccaaagtgctaggattacaggcatgagccaccatccccggactatttttgaatgacctgtttattattctgtgtctcctggatttctatgaagcatccattggctcttctacacttgtgctgttcagtacagtagccacaagccacaggtgactattaagatttaaactttagttaattaaaattaagtaaattaaaattttagttccttggtgacattagccacatttcagatcatcagtagacacacgtgacaagtggctgccatattggacagcacagaatgaacagtcctgtcatcacagaaagttctattggacagcactgttctagctctaccttccacagctcttattttttctccagtattctgcatctctatttttatggtcttcattctgagagatgtccttgactttattcagacctttaattggcatttaatcatggccattgcattattggcttctaatatttaattttgaattttatttggcaattagctttataaatgccaacgtttcttttgtttttctattgctaccttttcacagcagcatattcttattttattttttatttttattttttcattttttttttgtttatttgtttttttgagacagagtcttgctctgtcacccaggctggagtgcagtgacgtgatctcagctaactgcaacctctgcctcctgggttcaagcgattctcctgtctcagcctcctaagtagctgggattacaggcgcacgccaccacacccggttaatttttgtatttttagtagagacggggttttgccatgttggccaagctggtctcaaactcctgacctcaggtgatccgcccgccttggcctcccaaagtggtgggattacaggcatgaaccatcactcctggccagcatattcttattttgtaggtgaagtttgctcttgattatccccaaggacactaattcactttaaaaactatttttaaggtcttctgttttctgaattaactctgtttcctccataattaaacatcctgtttgttcatcttggattttctcttccatactgttggtttcctaaaatgtctattgattcttaattgtccatttatattttataaatacaaatctaggctgattcataacttacattcattctcttaacaattgaaactccatttccacagctgacatttctccttaattataagattgatgggaggctctcagtgtgccaaggtcagtaacagtcagatcagctcccacaattgctataaaaggaaggttttattttagaggtgagtgctttatttcaatcatgggtgaagctgcctttctatttttccctttcttccacttacattttgaatttacagaattatctgggtcctgatctgattctctcatctcaagacctaagagtcccccaggcagattctccaagtaatcagagagtggtaatcatggctttatcctgcagtgaaacattgcagccaactgctttatatagaatgatgactggctcagttgctccagggcagacctttaatttgtgactccaagttccacttctgctccttgcctttgctgactcctggaaactctttgaggaaaaaacatctctaacttatatttcaaatctctgctacatctatttcggatgtgaatttctctgctgtgatttctccaccaattaaataccaccttcattaattaatctttgcttttatggacctctagtgcattagattgaattaatcttcatagcaatcaattatcatcaatctataatgttcctctctgattattattactaatactattactttatttattttggtcttcatgcatgacaaaggcagtctcttttcaccaaaatgttagtcagactcccctgagtcttctgcttacctggcccgtccttgggcttttctctctgtcattgaagaatccagtttgagctagaatcctcaagtcagtttaatgaaaattcaccatccctgatatctgaccaccctggcctatcttcagcaagaattctgttgagtagccctgatgtttctgcttagtaattttcaattccctgatcctccaccctgctccttggttataaattcctgcgtgtccttgttggagttggggttgggtccagtctctctcccctactgcaagacctcattgcggtggtccctatacctatcaccatggcatccttgacaagtgtcatggatcatctcttctttaacatgcaccatcgcaactcctgctcctcttcttaggatgaatgtatttttgcctcatgtatgtttgtatttttaactagtataaatggtactaaaagccttgttttcttttttagtcaacattgtgttttaaatatacatccgtgacatcttataaatttctaattaatgctttaaaatgtacaatcctactgtgtgtgcagaaggaaaaaggcctggagatatttggggaacagcactaataacaaccattgtttgtcctcctggtcaacaaatattcagtttgctttatttcccctcagaaaaaatacactccttctgtatctaagggagttgtctgaaacatcacatggagtcctccccacctcctctcctcgggatgcacatggttcttgctttggccctgatttcctgccctgggagtagctactttgtcctttgttcttcttcttgttcctctggctctaccttctggaagattctttcttctccattatctgaagaaaccatcagcccatttcctgcccactggtggttgggtgccctagcccctttaagactcaaatttaaactttttttcactcataatttctttggcaacactcctaaaatttagtagccttcttatttatttgattccagtcagttccatatggcagagctcatctatagttattttctagatatatttcctgaatttgctacatttcttgtttcttcctttccccaacccttccccttcacttaattgcaggtaaggtgttaagcttatcaggctttgggggaaaagccacacatttagtctcttttcccagaaccattttgtcaaattaaaaggaattattgaatatctcacccttagttgacattcactttgagacatcttcatccattcaaaggtttttatcactggatgaaacagccataaatttgatccttgttgaaagcctgaaattttaattggtctttgtccttcaaagtcctgctcatttttccttttacttgttagggttgagaagcagttattcacaacttccaactttgcaagactccagttttctagttcttctcaatttcctttcattgctacttggaaacttgccaattattttctgagcttatctcaaatacagtcaataaaaacttatgctctctcctgtcttccttttcagagctaccttccaagtttttgcagatctaccttccaatattttgccactgcataacatgaatcactggccaggcacagtggctcatgcctgtaatcccagcaatttgggaggctgaggcaggcagatcacctgaggtcaggagtttgagaccagcctggccaacatggtgaaagcctgtctctacttaaaaatatatatacacaaaaattagccaggtgtggtggcacacgcctgtaatcccagctactcgggaggctgaggcaggagaattgcacttgaacctgggaggcggaggttgcagtgagctgagatcgtgccactgcactccagcctgggagacagagcaagatgccataaaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaaagaaggaaggaaggaaagaaagaaaaagaaagaaaggaagaaagaaagaatgacaaaaacatgaatcgccatcctttcaacagttgctaacagtttccttgcaacctgatggccagctcctaagccttcaaagccatatttttgattatattacggcaggtaggactccacttctgtatcaaccaggatagatggattatgctgtggtgacaaacaaccttaaacaaccataaaatcataatggcctaacaccccaaagagtatttcttggtcattgcaagtcagcagtggtctcctttcatagccactcaggggcccaggccaatggagtggccaccatctctaacattgcttgtcatcacaccaaagggaaagaaaatgtggtaaacagcacattggcttttaaagcttctacttagaagtgatacttgtcacttaaattttatggacaaagcaagtcctatggccacacctaacttcaaggaggcaggcaagtggaaatatggccgctaatcatagccatgtatccaggaggagaagaagaaatatttgtggaatggtactatctcacataatttgcctattttttattgttgtttctgtcttttgttgttgattgttagagttccttgtaggatctagaaaatgttatgtactccctcatcagggagtacatttgttttgttttgttttgttttgttttattttgagacagagttttactcctgtcgcccaggctggagtgcaatggtgcgatcttggctcactgcaacctccgcctccaaggttcaagtgattctcctgcctcagcctcccaagtaactgcgattacaggcatgtgccaccatgcccagctgcattttttgtatttttagtagagacggggtttcactatgttggccatgctggtctcgaactcttgaccttgtgatccgtccaccttggcctcccaaagtgttgagattacagatgtgagccactgcgcccagcccctcatcagttttaaacattgaaaatatcttctctccatccttcatctgttaattttgtccatagcatccttccttcactgtgtagaaatcctttatgttggtgtagatccattcaccaatttttccagatgaaagtttttgcttttggggtcttattttaaaaatcctttccccatcccaaagccacaatatgtaattatatactttctcctattaactatgtattttactttccatatctaaattttaatacagctagagttcacctttttcttaaggtgtgaagtagggatcttttcttttaatccataaaaggagcgaatattcttaataccatcaactataaaattaataatttctccactgatttatggttccatttttatatttcaaatttatgaaatctgtttttgtcccactagtctatatgtttgttccaattctttctagtatagtactatatttttgtagaatattgaaacaggatattttcatgaccccttcccaggccttgcgaaaggggtgtttcacttactcagcccgcagtgctccaccgctcgtaggaaggggagcacatgtgagcaggtgcaggagccagggtgagtgcttttgggtgctgataggagcaaaactccatgtgggccctgtagcagtgactgggggtcgtccctgcaacctctgaagccccagaaggagagttacagtgcccttttagctttgccatctgtggactgcttaagagttaacagctca
